United States Patent 8,178,340 (HUMAN SPECIFIC ESCHERICHIA COLI STRAINS) - sequence listing, part 3

SEQ ID NO: 7 - DNA, 5092707 bp, Escherichia coli (residues 3,395,139-5,092,707 of 5,092,707)
  misc_feature (1412423)..(1412522): n is a, c, g, or t
  misc_feature (1638195)..(1638294): n is a, c, g, or t
  misc_feature (1959934)..(1960387): n is a, c, g, or t
  misc_feature (2351498)..(2351597): n is a, c, g, or t
acggatgaaatcctcaagctagttccttcactgaaaaatttcggcaaccgaattatcgccattaccaataatggaaattccacgctggcgaaaaatgctgatgccgtgctggaactccacatggcgaatgaaacctgcccgaataatcttgcaccaacaacgtctaccacgctgacgatggcgatcggcgatgcgctggcgattgccatgatccaccaacgcaaatttatgccgaatgattttgcgcgctatcacccgggcggttcattaggtcgtcgcctgctgacccgcgttgctgatgtcatgctgcatgatgttcctgcggtacagctggatgcgtcatttaaaaccgtgattcaacgtatcaccagcggatgccagggaatggtgatggtagaagacgcagaaggtgggctagcgggcattatcaccgacggtgacctgcgtcgctttatggaaaaagaggattctctgacatccgccacggctgcgcagatgatgacacgtgaaccgctgacgctaccggaagacaccatgatcattgaagcggaagaaaaaatgcaaaaacaccgcgtctcaacgttattggtgaccaacaaggcaaataaagtcactggccttgtgcgcattttcgactaattaagcaacggggtgcgagaggttagtctctcattgagtttgcgccccactgaaactttgataatcgttacatgttgataaaagtgaagcctgccgtatcctggatgcgtgctcgtctatctgccatctcactggcagatatccaaaaacacctggcgaaaatcatcattctggcaccgatggcggtgctgctgatctatctggctatcttcagccagcctcgctatatgagcgagtcgaaagtcgccattaaacgctcggatgatttaaacagcggcagcctgaattttggtctgcttctgggtgcctctaaccccagttccgcagaagatgcgttgtatctgaaagagtacatcaactcgccggatatgctggcggcgctggataagcaactaaattttcgtgaagcgtttagccacagcgggctcgattttcttaatcatcttagcaaggatgaaaccgcagaaggcttcctgaagtactacaaggaccgtatcaacgtctcgtatgacgataaaaccggattactgaatattcagacgcagggctttagcccggagtttgcgcttaagtttaaccagaccgtgctgaaagagtcagagcgctttatcaatgagatgtcacatcgcatcgcgcgtgaccagcttgcctttgcagaaacggagatggaaaaggcacgccagcgtctggacgccagcaaagcggaattgctctcttatcaggacaacaacaacgttctggatccacaggcacaggcacaggcggcgagcacgttagtgaatacgctgatgggccagaagatccagatggaagcggacctacggaacttgctgacgtatctgcgtgaggacgccccgcaagttgtgagtgcgcgtaatgcgattcagtcattgcaggcacaaattgacgaagaaaaaagcaaaatcacagcgccgcagggtgacaagctaaaccgtatggcggtggattttgaagaaatcaaatcaaaagtagagttcaacacagagctgtacaaactgaccctgacctccattgaaaagacccgtgtagaagcggctcgtaagctcaaggtgctgtcagtgatcagttcgccacagttgccgcaggaatcgtcttttccaaatatcccttatttgatcgcctgctggttactggtgtgctgcctgctgttcggcaccctgaaactgttgctggctgttattgaagatcaccgagactaacgctgtcgctgaatgagtttgtgatgaaattatttaaatcaattttactgattgccgcctgtcacgcggcgcaggccagcgcggccattgatattaacgctgacccaaacctgacaggagccgcgccgcttaccggtattctgaacgggcaacagtcggatacgcaaaacatgagcggcttcgacaataccccgccgcccgcaccgccggtggtaatgagccgtatgtttggtgctcaacttttcaacggcaccagcgcggatagcggtgcgacggtaggattcaaccctgactatattctgaatccgggtgatagcattcaggttcgcttgtggggtgcgttcagctttgatggtgcgttacaggttgatcccaaaggtaatattttcctgccgaacgttggtccggtgaaagttgctggcgtcagtaatagtcagctaaatgccctggtcacatccaaagtgaaggaagtataccagtccaacgtcaacgtctacgcctccttattacaggcgcagccagtaaaagtgtacgtgaccggatttgtgcgtaatcctggtctgtatggcggcgtgacgtctgattcgttactcaattatctgatcaaggctggcggcgttgatccagagcgcggaagttacgttgatattgtggtcaagcgcggtaaccgcgtgcgctccaacgtcaacctgtacgacttcctgctgaacggcaaactggggctttcgcagttcgccgatggtgacaccatcatcgtcgggccgcgtcagcatactttcagcgttcagggcgatgtctttaacagctacgactttgagttccgcgaaagcagcattcccgtaacggaagcgttgagctgggcgcgccctaagcctggcgcgactcacattacgattatgcgtaaacaggggctgcaaaaacgcagcgaatactatccgatcagttctgcgccaggccgtatgttgcaaaatggcgataccttaatcgtgagcactgaccgctatgccggcaccattcaggtgcgggttgaaggcgcacactccggtgaacatgccatggtactgccttatggttccactatgcgtgcggttctggaaaaagtccgcccgaacagcatgtcgcagatgaacgcagttcagctttatcgcccatcagtggctcagcgtcagaaagagatgctgaatctctcgctgcaaaagctggaggaagcatcactttccgcccagtcctccaccaaagaagaagccagcctgcgaatgcaggaagcgcaactgatcagccgctttgtggcgaaagcacgcaccgttgttccgaaaggtgaagtgatcctcaacgaatccaatattgattctgttctgcttgaagatggcgacgtcatcaatattccggagaaaacatcgctggttatggttcatggcgaagtgctgttcccgaacgcggtgagctggcagaagggtatgaccaccgaggattacatcgagaaatgtggtggcctgacgcagaaatcgggtaacgccagaattatcgtcattcgtcagaacggtgcagccgtcaacgcagaagatgtggattcactcaaaccgggcgatgagattatggttctgccgaaatatgaatcgaaaaacattgaagttacccgtggtatttccaccatcctctatcagctggcggtgggtgcaaaagtgattctgtctttgtaaggagttgaaatgagcaaagcagttattgtcattccggctcgttatggctcatcgcgcctgccgggtaagccactgctcgatattgttggtaaaccgatgatccagcatgtttacgagcgtgcgttacaggtggcgggcgttgcggaagtttgggtggcaacagacgatcagcgtgttgaaaaggccgtgcaggcatttggcgggaaagccatcatgacgcgcaacgatcatgaatccggcaccgatcggctggtcgaggtgatgcataaagtcgaggcagatatctacattaacctgcagggcgacgaaccaatgattcgcccgcgggatgtagaaacgctgttacaaggaatgcgtgatgaccccgcgttgccagtggcaacgctatgccacgcgatttctgccgaagaagcgaccgagccaagcacggtaaaagtggtggtaaatacccaccaggatgcgctttatttcagccgttcgcctattccgtatccgcgtaatgctgaaaaagcgcgctacctgaaacacgttggtatttacgcttatcgtcgcgatgtgctgcaaaactacagccagttaccggagtccatgcaggagcaggcagaatcactggagcagctgcggttgatgagcgcggggatcaacatccgcacatttgaggttgccgcaaccggtccgggcgtcgacaccccggcatgcctggaaaaagtgcgcgccctgatggcacaggaactggctgaaaacgcatgattggcatttactcgcctggcatctggcgtattccgcatctggagaaatttctggcgcaaccgtgccagaaactttctctgctgcgccctgttccgcaagaagttgatgctatcgccgtgtggggacatcgtcccagcgcggcgaaaccagtcgccatcgccaaagcagcgggaaaacccgtcattcgtctggaagatggatttgtgcgttcgctggatcttggcgtcaatggcgagccgccgctttctctggtggtggatgattgtggcatttactacgatgccagcaagccttcagcactggagaaactggtacaggataaagccggaaatacagctctgataagccaggccagagaagcgatgcacaccatcgtgaccggggatttgtcgaaatataacctggcacctgcgtttgtggctgatgagtcagaacgtgcagacatcgttctggttgtcgatcagacatttaatgatatgtcagtgacgtatggcaatgctggcccgcatgagtttgctgccatgctggaagccgcgatggcggaaaatcctcaagccgaaatttgggtgaaggtgcacccagatgtactggaaggaaagaaaacaggttatttcgctgatctgcgtgccacgcaacgagtacgtttgattgccgagaatgtcagcccgcagtcgctattgcgacacatttcccgggtttacgtcgtgacctcccaatacggctttgaagccttgctggcaggaaaaccagtaacatgtttcggccagccctggtatgcaggctggggcttaaccgacgatcgccatccgcagtctgctttgttatctgcccgacgcggttctgccacgctggaagaactttttgccgcagcatacctgcgttactgtcgctatatcgatccgcaaacgggagaagtaagcgatctatttaccgtgctgcaatggctgcaattacaacgtcgacatctgcaacagcgtgatggttatttatgggcgccaggcttaacgctgtggaagtcagcgatcctgaaacctttcttgcaaacggcaacaaaccggctgagtttttcacgtcgctgtactgcggcgagcgcctgcgtggtatggggtgtaaagggagaacagcaatggcgagccgaagcgcagcgaaaatcactgccgttatggcgaatggaagatggttttctgcgttcatccggacttggctctgaccttttgccgccgctatcgttggtcctggataaacgcgggatctactatgacgccacgcgcccctgcgacctggaagtgctgcttaatcacagccagttaacgctggcgcagcagatgcgagctgaaaaattacgccagcgactggttgaaagcaaactgagcaaatacaacctgggggctgatttctctctgccagccgaagccaaaggtaaaaaagttatcctggtgccgggtcaggtagaagacgatgcctcaattaaaacaggcactgtctcgattaagagcaaccttgagttattacgcacagtacgcgagcgcaatccgcacgcttacattatttataaaccgcacccggatgtactggtggggaatcgcaagggcaatattccggcagaactaattgctgaactcgctgattatcaggcactggacgcagatattattcaatgcatccagcgcgcagatgaagtgcacaccatgacatcattgtccgggtttgaagcgttattacatggcaagcaagttcattgttacggcctgcccttctatgccggttggggtttaaccgttgatgaacatcattgcccgcgccgcgagcgcagattaacgatagcagacttgatctatcaggcgttgattgtttacccaacatatattcacccaacacggctacagcctattacggttgaggaagctgcggaatatttaatccagacgccgcgtaagccgatgtttattacccgaaaaaaagcggggcgggtaatacgctattgccgcaaattaattatgttctgcaaggtcagatttggctaaacaatttcatagttgactattacacagattatttatgcaaggcaacgcactaactattttattatcgggtaaaaaatatctgctattgcagggaccgatgggaccttttttcaacgacgttgccgaatggttagagtcattaggccgtaacgctgtgaatgttgtattcaacggtggtgatcgtttttactgccgcaatcgacaatacctggcttactaccaaacgccgaaagagttccccggttggttgcgagatctccaccggcaatatgactttgataccatcctctgctttggtgactgccgcccattgcataaagaagcaaaacgctgggcaacgtcgaaagggatccgctttctggcatttgaggaaggatatttacgcccgcaatttattaccgttgaagaaggcggagtaaacgcatattcatcgctaccgcgcgatccggatttttatcgtaagttaccagatatgcctgcgccgcacgttgagaacttaaaaccttcaacgatgaaacgcattggccatgcgatgtggtattacctgatgggctggcattaccgtcatgagttccctcgctaccgccaccacaaatcattttccccctggtatgaagctcgttgctgggttcgtgcgtactggcgcaagcaactttacaaggtaacacagcgtaaagtattgccgcggttaatgaatgagctggatcagcgttattatcttgccgttttgcaggtgtataacgatagccagattcgtaaccacagcaattataacgatgtgcgagattatattaatgaagtcatgtactcattttcgcgtaaagcgccaaaagacagttatttggtgatcaaacatcatccgatggatcgtggtcacagactctatcgaccattaattaagcgattgagtaaggaatatggcttagatgagcgagtcatttatgtgcacgatctcccgatgccggaattattacgccatgcaaaagcggtagtgacgattaacagtacggcggggatctctgcgctgattcataacaaaccactcaaagtgatgggcaatgccctgtacgacatcaaaggcttgacgtatcaagggcatttgcaccagttctggcaggccgattttaaaccggatatgaaactgtttaagaagtttcgggggtatttattggttaagacgcaggttaatgcggtttattatggggagtggatgtttgaacatgaaattaaggtagatacggaaaccaatgttatctcaagttcgcacctatgatgacctgaatttaattatgttttaatcaaccatatttttataaaatgatccctcaacagtgatttcacatatttttttattataattgtagacaaattaattgtttttgttcagttttcattatttaaaagtcctgtcccactttatattctctcttattaactgggccgggacaccagaataaattgagtttttcctttttagttcttttgaaacaaatgattttgctccaattacacatccatctggaatgatgctgcctttattaacagtaacaccttcacataaccaaacgttattaccaatgaatactggttttgcatgatttattcgctcattactttcaagatcataaataggatgctcatcagagtttcgtatatacacagaactagataacatgcaatttgaaccaatattaatctctgagccttccattgaaaatatattagcagacacagatgtggtataagaatcaatgataatgaccgagttgttctgcctcaaatgaatagccccacgtatactacagttattctttataatcaacttacaattattacccaatatatttatatttaatcgcctcaatataaccgagtcacctatatcgataacattatcagtaccaattatatttacattaacatcagatgatattttagcattagaatgaataataatattattgttatatttaaaactatcaaatttattcacaattaaaaacctcacaagctcctgcacatataaaaaacgcatgtatttttattaaaaaataacaaaagcacaccactgtcattcacgaagagtttaataccccttcgtgaatgaatattcaacgcatttttatttccaggaggccattttttttatgattttgtattttgagtctttaaaaaaatcatccctattattttcatacttaaggaatttcttttgagatacgagtgactttattattttagcctcaacagcccttttccagttatattttatagtttccttggaagtaatattagtcggcgttttaacagactctttcaattgtggagatggttttgaagacttgttcgccactgctttttttgaatataaaacagcagccccctgacgccatacagagtcttttgaaaaatctttatccgtaggtgaaattatatatttccgtttcacaccagcaagagcatcttcaaatgtgtgtccgataaataactgtgcatctgcaaaatcaggtgtttgtaaaaaagagctaagcgtacgttcagcaaggaagggatcaatccagatttgatcaatagaatccctaaaattattcatcatgtcagttgcaaattgaattgccccctgatgaactaactctaacaaaatacgtcgatggccaatactactttctggacggaagattggtttaaaaccatcatcatcagatattgtgatcaggctaggttctgtatgacatattaaatattctattagaggcctattttggacaacatagcttggatgattagcagatagtaaatcccccataaaaccattgcatttcagccccttgtcaaaccaaatctctgttccttgtaaggttgcataataataaccatctaatggtttatttattagagatgaaagtgcaccttgcatattagctcgccaccctatatcaacaattgctggttttttttctgtgctaagaccagtgctattgacataattaagatagctttttctttcattttttgcatgagttagtattatatcactaataatagtgcataaatttgataactttttacgctctacaaagtcagtagttaatttatcttcaggacctataaagccagcctcttcccattgttcctgagttatcttcgttacattaataccaaacctgtcttctaaaagagtaccaacggtaatattgccttggtatggatggctggataaagatattacatcactaagtgttctcaaactagcaacacgagttgctcttcttgaagcatacaaatatgttgtcgatggtacatctttatcatctttatgtataacatcataaacttgttttaaaagccacccttcacgtgacaggaaatataagtgagaaatattatcttgtttagctttgcgtcctagccataacatgaaagcagagacgaaaggaccaatccctgcatatcctaaattaacaggatcaccatagaaatggctctttttagcacccggatcactttcactatcaaaaatcttttgtgctgttaatccggctaataaagagcgagacaattcattattacctattttttctggatatatttttgagtagacctcactactacgcaaacggtcgatagaacgtataagtctatatgttttaatacctctagacttaggctctttattatcagagatattattatcaccaatgtgcaaaatattatcaggagatactccggactcattaataacaagatcaaaaagccccccttcttttttactgacaccgtattcatttgaaatatatactttctcaaagccatcatatccattaattttaaggatgttaagaatagcatccttaggtaaatacatatcagatatgatgtaaataggtttacctgttttttttgctatatcccacagctttttaccagcagggcgaggtttaattatttttgtttcatactcaacctccgcccatttcatgttattaattgtttctctatccagcttgtaaaactcttttatcttatcgtaaatttcatctaatgttacctcttttgagtctttctcattcctagcttcgacctctgagacgtgtctaattcgagaaaagttttctgccaccccattactaatatgtagcatttttgtttctaagaacttaaaaacatcaattggcacttctgttgggcgataaactaatgtatcaaaaatatcaaaggaaattattttaatagctgagtcatttacaaatttactaaatcgttttaattcatttattttattactaattggtttatttatttgacttaggtctttgattactcgttctgttcggaatgagttgaatagcttgtcttcatatttttcatcaatagataaaaatgaaggtaagtcatatatattatttataccactacgcttgacatttaataaatctttaagaagtctggacaaaaacttcccatctttgatgacagagtgtgcaaggggttggtttcttgttaatataaatgacagaatgtttagcgattctttcctcaaagtctggtaatgtaatggagaactgttattggaataaggagttagatatgtatttccataaactttaagttgtcgtccccaagaaatcccttgtaacccaagagatgacgaacatgttacaacctcatctactaatggtaataaaaattgagatatgctgctaattttatcgaaaattggatagtatatgagatttggccacttagctttaagactgctaaccacatcattagttaatattgtatccgcaactctaggtgttatatattgagtgactacaatacctgttttttcatcggaatccttaaggacatcaagtaaaaactccatctgattggagtatggtgtatccgattgaaaagagtaatgagcactaacttgtaagggaagaagaattaacttctcatacttttctgtaggatcaaggtcttttcttttaaatggtgtaagtgtgtttatctcatattttgatctatctataaataagttagccaaacttatttcattctcttgaaaattacattttttaatatcttcgctataaattgaaagagtgctactcttataaagcccattaatatcgaatgttataaaatgtggatatggaggtctactgaatactccaggcatttgatttactatcaatgcatcagggaacattttttctaaaaatggaactggcgtctcccaaagcaaaataacatcataatgatcatccaaatagtttgatagggtactggaaatattttcaattttctttttaacattatccttttgcttgtaaaactcaatcgacaaatcattgagcgaaccaaagcaatttatttgatcatttatattaaagtttattatctttatatttttacatgcaaaagagcgcagaatatcaaggttcgaaggaagaaataatgtgacatcccaaccttcttcagaaagaatattaccttgtgggattagatgattttgaacagcatttttataaaaattcaaatcaccatgtgcggaccaaggcggaacccaaagtaataatttcatatctacctctaacttaatctataaatttttacttactgctacttagcatattttcacaatataaatggcatatagtagatggtgcaaaaatatttaatcactcgtagtatttagctttaccaaattaaacatgccctttgcaattatttttatcgatacaataaacaatttactttttgatatattctaattatataaactatcaaaatttagttattgttaaataatgtcacgtagaatccagatatctaacttgtgagcaataaattccgatactcatctaccccctcctgaacatcctcatgaaaactaaccgcattgtcatccttaaacacaatcgccacatcacaaaactctttcaatgaattcaaactatgtgaaaccattaaaaaactagattctttatgcctttctttaaacaattgagcgcatttttctttaaacctggcatcaccgactgcagttacttcatcgacgatataataatcaaacttaaatgccatgcttaaaccaaagcctaaacgcgatcgcataccagatgagtaagttttaatcggcatatcgaagtacttaccgagttcggcaaattcttcgacaaactcaattttctctttcagctcttcttgcttcgcgtataaccgcgcaacaaattttacgttttcgcgtccggttaaacttccctgaaatccacctgcgaggccgactggccatgatattgttttattagtgatgatctttccactgtcggggcggtcaatgccgccaatcattctcagtaacgttgatttacccgctccgttgcgaccaataaaggcaacactttttcctgaagggatttcaatatttaaatccttaaagacataatgtcgacccgctggcgtgcgatatgacttcgtcaaattttcaatcttaatcatgatgtcagcattgcctcttcacgcgttaggtataaagccagaccgatgaacagggtgaccagagtgaacattgcaaggtagttcagactaacgccttcgctgatatagccaggcataactgcctcgcggcttaactctacgacatgcactaatgggttccagagtagatatgaccagtattgctttggaattgagtgcagagggaacatgatgcaggagatgaaatacagcggcttaagcagtatcggcaggaccttttgcatttcagggaaagtcttaccaacgaccatgaatattaagccgacgccacatgaaagaatgattaacaaactccaggtgagcacaagttgtaaaaaatttgttatctcgaaatattcgcctgccatccagacgataagcataagcagaatataaacagcaacgtaaatcagcgtctcaagcagggcgcgcgcaatgatcgtatcgatgggttttactggtcgataattaaacagcccctgattcgcttcaatagcacctacagaacgattgctgatactgctaaagataaaaaagggaatcaggccattaagtaaaaacaccgggaatgagatgtctggcatcgtgcggtgcataatgtaaccaaaaatgcccaacagtatcagcaaatgcgcagagggttcgagaatcgcccacagatatcccagacggaacttaccaaagcgtgttcgtatttctcgtagaaataatgcctctacggtgactttctggacttcaaatccacttcttgccatttgatgatgtgatcctaatctcttcaggtacgctaccgcccttggcttaacagctaccaatacactggaggtaatgcttatttgtaactggataaaatttactcagacggtttgacctttttaatagccgcaaaaaatttcagcagaaattatttccgcagggataaatagatctatttccgtctcgtttcttctaatccattcttcaggcatgaatgtattcggtcttctggtaatttcagaaaactggccgttttagaatgtagagttaatttctcaggaaattatttctacctctttttgcttaaccaatatggcttgaaaaagacgtaaagcagcatgcgttctggattactccggaacacacttattcaaaatgggctgctaatttcgcaagaaattattttttactattactgttaactacttgattataataccacctatgaattttatgcgtaacaacacctgcaatctgtctcaaaccagaacgcacgcgattgattaccaataaattgtttagtgagaaactatttccctatttaaaattcactcatgtacttcttatttatatctacagccccctctttacagtcacatttgtgatttacatcacatttaaacggtgttatttaagccccattaataattccgtgggtaattattttcgtcaattaaaatatacatcttgattattttgtgtatttattttaaccagtgttacaaccaacaccatccctcagtagatatacctgagcagacatttcttaaaatcgacgaatagtttccctgggaattattatgcttatttgaaattccctttctgattatctccagtaattttactaatttctaggctacacaaaatacagatcacataagaattatcctatatgttttgacctatcaattgttactcaatgatttattacaactattaataatcataatgtgtcaaaacacttaagcatctttacagtcttagaaagatgtcgattaacgaaggctacatggtgaaaaacaggttccttcagtgttaccgaatattccgtggtggtctggagggagataattcttgctacatcgaaactcagcccggtgagcgggtttgacagttccgcactcaccattgggctaagggttatcaggtggggttaaggaaatggcaatacctacccccgcccaaactccagtcgctgcacattcaccatcccaggcttctcagcagcactgacatcaatttgtgtcacccgcagcgcatatttttcatccagtgcgtttaaccagttcagcaggtcattaaacaccaccggatctatccagacctgaatattctccccgcgctcggctattcgcttaatgaccactgaatgcgccgaagcactgtcgctgatgacccgcgatacctgtgctggcgttgtcgtgccggattttcgcgccgcaataatatccggcgcggcgctcttcagtcgcgcgttcatcgccaccagctgctgcaacatcgtctcctgttgctcaatccgttcgctcaacggctgccagatgagaacgtaatatccggcgctaaacaggaacactaccgctgccagtaacatgcctttttcacgcggagaacgccccgccaggtgttgtgtcagccagtgttcgccacggcttaactggcgttcacgccattgctgaaaatagtgaataaatttatcgcgtaacatgttatttcctccgcaacgttacgccgccggaaaccgcatcaccctctttctgtaacgcgtcctgttgcacaacataatctaccgccagtgcgctacgcagtttgtcgaagctggcaaagttcgcagcccgtagctggaggtgaagcgtctggcgtttttgatcaaaggtgaaaccacgcatctcaatgtcggaaagtaatgcggatttcagggtactggcgatcgcagacaactcggcaagcagatcggtatcatcagcctgtgggcgatattttttcagcgccatcgccacctgcgagcgtaaattcacaatccgcttctgctccgggaatagcgttaagaactgtttctccgcctgggtgcggctttgcgccacctgttcgctgacgctccataacgtcacgccccgttccactaccagcgcaaccagaatcagcaatatcggcagaatcatcacccgccagcgcgcccactgttttcggtagctgacacgaggctgccacggccctgttagcaggttcccttccggttcgccataagtggtaatggcgggcagagccgtaacggtcaggcgttcggcgtccgcaccagcccatgcagacagttcttccggtgcaatgccgaccacagttagtgaaatcggtaaattctgctcattgagctgtgcgcggaacatgaccggagccagcgcccgcccggcgctccatccccggcattcatcgatgcggcagataacccgttgcgcatcgccagccataaacccacaaggaatggacatccagtccggcgcgacggtagcgcgggtgatgccgtttgcctgcaaccactgcgcaatgttgcgcatatgctgctggtgaatcacagctacggttgccagttgctggtcgattttcaacggggcgaaatgcagttcatcgatatcctggttcagctcttcttccagcaaggcgggcagaatcgtcggtatctgcttgcggggcacatcaggcagttcaacctgccagacgctgatccattcgccgggaatgtagagtcgaatcgcatcagtttgcagccattgctggagacgttcgtcagcaacgtcaggccagataccgtgctccacgtcgggtgtatggcgctgccaacggatgggatcagcggcgcaaagcgggaaaaaaatctcaagcatggaactcactcactttctcctgtctgatgccagagaacagaaaagtgttgtgggcccatgcggacaattaacgaattcatcgtcagttcaatctcattcacggtgatatctgaacgcagccagaagtaattgctgtccacgctcaggatggtttttagctgttttttagtacgctcatcgacgtctgcaagtagcggctgagcaagaaactgatcgacatcttcccagcccttcgccggacgttgttgtaataatgcccgcgcctgaacagggcttaaccacgggtcaaacagcgcctcaagaatcacactttgcgtgacatctaatgtattgatgttgatttgctggcgggccatcggcagcgcacagaccaacggtttcagtttttgataaagcccggcgtccattccctgcaccacgcgcatctcgctgatatcagccagcggttgattagcggcgtagaacggcaccgagcgggcgagatactcgctgtcttcacgacccagacgcgtctgcacgctgcggtcttcgtcaataaactcccacaggctttcggctatcagttcggcccgataagcaggcacatcgaggcgcgagatcagggcaatcagttgttgtaccgcgagcggacgcgacgccgtcgtcggctgagcgagggcattcaggttaaagcaggcctgtgcgtcacgcagagtgacggcaatttgcccctgcggcagtgggaaaaaacgcgggccagaagcccacggctgtgccagatgcacacgcttttcatttttcaggctcagactgagcgcgctcagcgccaggctttctgcactggcgctgtaccacagcgcctgctggtactcctgctggctgcgcgttcgcccaagttgttgctgcatccgactggaaagcgtgatggttaccagcattatgaccgccagcaataccagcaccacgaccagtgccattccgcgttttggtggtgaggtgatcatgataattgcggcccgcgtaacaaccagatgcgttcaatttcgccccattgtggcgaatgcagggttatgcgtactgccacaggaatcgcctgcactgatgaccaactcgcctgccagcgcgtgccgtcgtagaactgcaaacggagcgaatccgccgggattaatttttgcgttgttggcttcacgctgcctgccgcatcggtcagtggccaggctaaccgttcgagataaccaccatgaatgcggtaaccgacggtgagcagattactgcgcggcagacgcatcaacggattaaccacgccgccacgtacaaaacgcatcccttcactctcagacgccagcacgccagcgcccgccagtaacgctggttcacgctggccctgatcgcctcttaccggacgcggcatcatttgtgtcagatcgtggttcaaaaaactcatcgtttgctgcatgaggtttagtttttgatcgtgtccggcgacggcgctattcacgcgtgtaacgccgtttgtcacctgctgcgccatcagtgccagtgaggcaaaaatggctattgccaccagcatttccagtaacgtgaaaccagcgcgagcccttctcactgttggcctcccacggcgctaaaccaggcgcgtcgtgactgaatcactggcgaaaagtcgtcatgaagactgacttcaatatccaccgcctggagcagcacgttaccggtattcagagggatcgttcgccagtaccagcggcttcctgccatatcactctcgccctggtgcctgaccgctcgttgttcacgggtcatcaggtaaagcagcgcggtctggttttcagctacccaaccagccaccgttttttcctcaagaacgtgctgattactcagcgcaccgctggcaatctgtaacaccgccatggcgaccaacgcaaaaatcgccagcgcgagcattacttccagcaaggtaaatccacgcttcatggcatcccctcatcacattgattgagggataacgcgccatcgtgcaccagctttaccgcccaacacgcgttttgtgccgacgagtaaaaacgcagtgtaaacggcgtgacaggttcaaaaggcgaaaaacggatctgcggtgtcttctttttcgcctctttttgcagctccagttcaatatcgtgcagcgtcaggcgacgacgctgcagctccagcgcatactccttctgccagatatcactgccgggttgtaacagcatctgcacctgtttcggcaccgtaacctgtgccgataaccgggtcgcagaaacgggcaaccattgcccgtgacgacgctgcataaactggtaacctggcgggtcgattagcacgccgagtgtttgcccttcgatcactgccctgtccttaaactgcgcaaagcgagtcagaaaatcctgcgccgcttttttcgcaggcggctctgaagcggtcgcaaacgtctgtaccacgcccgcactggcaaggccgataaggaaaatcaccagcatgatttccagaagtgtgaatccgcgttcaggcactgattactgaaactcctgcaaattccagttaccgatatctgcgccagcgccctccccgttttcctgaccatctgctcccagggtataaacatcaaacagccctttttcacctgggctgagatactgataatcattgccccacggatcctttggcagtcgtttaatgtatccaccggtacggtagttacgggaatccgccatattggccggttgctggatcagcgcctccagcccctgttcggtagtcggataacgcccgttatccagtcggtacatatccagcgcattctccagcgccacgatatcgctgatggctttttgccgatcggctttctctttgttgcccagcaggttaggcaccaccagacttgccaggacgccaagaataacaatcaccaccatcacttccagcagggtaaaacctgcccgtggtttttgtgtgcgggataacgaattcatgtgataactccgtaaattacattccaaccatattgttcagttgcagcatcggttcgaggatggcgatgacgataaacagcaccacgcccgccatcatcaccaccagcgccggctcaaacagccctaacaccagccccacctgggtatcaaattcccgttcctggttgaccgcggcctgttcaagcatggtttccagctcgccgctctgttcgccggaggcgatcatgtacagcatcatcggcgggaacaggcgcagatccgccagcgcggcgcgcaggctgcttccttcgcggacgcgatctgccgccagcagcagttgttgctcgacataacgatttgccgacacggcggcggcggtctgaatgccttccagcagcggaacactgctggcggtgaggatgcttaatgtgcgggaaaaacgcgccgtattcagtccgcgcgcaacacgccccgtcacgggcaggcgcagcaaggttttatcccagcgcaggcgcatcgcaggatttttgagtaaccgttgccccagcaccagaagccccagcaaacccgccagccagtacacgccgctggcctgtaacgcgtcgctcatagcgatgagcattcgggtggaggcaggcagcgcgtgtccgagatgatcaaactgttcgataattttcggcactactgccgtcagcaaaatagtgaccacgcccgttgccaccaccagcagtaccagcgggtagagcatggcctgcagcaggcgtgatttcagacgctgccgctgttcggtgtaatccgccaggcgattgagcaccacgtcgagatgcccggatttttctccggcggcgaccatcgaacaaaacagggagtcaaagacgcggggatgttcgcgcaggctgtccgacagggtataaccttcctgaatccggctgcgcagcgccattccgaggctttttacatgcagtttttcgctttgctcactgaccgcctgtaagcaggtttccagcggcattgctgcctgcaccagcgttgccagttgacgagtgaacagcgccagatctgccgccgccacgcgacgatgtgcgtgccgccgacgctgcaacaatccccctgccgatgcattcatccgggcttcaatgtgcacgggaatgaggtctttaccgcgtaacaattgacgggcatgacgcgcggaatccgcctcaatcatgcctttggttttgcgaccattacgctccagcgcctgatagtaaaacagtgccattacgcctccatggttacccgcagaacttcatcgagagaggtttctccggcgagcactttctcaatgccgttactgcggatacccgcagagtgttgccggacataacgttccagctccagttccccggcctgacggtggatcaaatcacgcaatgtggcgtccaccacaatcagttcatggatggcagtacgtccgcgaaaacctttgtgattacaggcggggcagccctgcggatggtacagcgtgacggcatgcgtatcggagatccccataagacgtttttcttcgtcggtggcaggcgcggcctgacggcagtcggagcacagcgtgcggaccagtcgctgcgccatcacgcccgtcagactggaagagagcaggaaaggctccacgcccatatcctgcaaacgcgtgatcgcccccaccgctgtgttggtatgcagcgtggaaagtaccaggtgtccggtcagtgaagcctgaacagcgatttctgcggtttcggtatcgcggatttcaccgaccatcaccacatccgggtcctgacgcaaaatcgcgcgcaggccacgggcgaaggtcatgccgacgcgggtgttaacctgcgtctgaccgatcccttcaatcatgtattcgatagggtcttcaaccgtgagaatgttacgcgagtggttgttcagctcctgcaatccagcgtacagcgtggtgcttttgccggaaccggtcggccccgtcaccagaaaaatgccgtgcggtttgtgtaacagctggcgcaactgcgcagtcagttcgagacttaaacccagacgctccagcgtcaggcgagcctggtttttgtccagcaatcgcagcaccacccgttccccccaggcggaaggcatggtagatacacggacgtcaatcgcccgaccgcccagcagcagcgcaatacggccatcctgcggtacgcgcttttcggcgatatccagtcgcgccatcaccttgatacgcgagaccagcagcgaggccagtttacgaccggggcgcaacatttcatgtaatgtgccgtcaacacgaaaacggatcaccagactcttttcaaacgtctcaatgtggatatccgaagcgccttctttgattgcctctgccagcatggcgttgatcagtttgatgatcggcgcatcgtcgtcactttccagcagatcttccgtttccggcagttcttcagcgagggtaaaaaagtcctcggcggaaccgagatcttccatcagctggcgagcttcggaagagtcccgctgccagaccgcattcagccgctgttcaaattcagcctcgtcgatttgccgcagtgtaaagggcgcattcagcccccgctgtagctcctgtaaaacagagagcgacaacggatgaacatggaggatctccagcgacgcttcgcaccatgccaccaggctaaaccgacggctgaaactgtagggcagacgcacggtgttagcggtggtttcctgtgctacaggcaccattaacgcgttctcccggcattaagaaacgcacgaacttccggcggtaaggcctgattttgcgctggcaatatcggctgcgcggtgtgcggcatcaggcttaagccttgctcatcgcggtagatttgctcggcgcgcatgtagttatatttgcgctgcgacacgccgtctgccgccataccgtcacgcagaatggtcggacggataaacaccatcaggttacgtttttcttttttatccgccgtcgatttaaacaggttaccaatcaatgggatatcgcccagcagcggcactttcgccacgctttctcccgcctggtcgtccatcagaccgccaagcacgatcagctcaccatcgttagccagcacggtggttttcagtttgcgctcgccaaacacgacatcgagactggtctgcccttccactttcgagacttcctgctcaatcaccatctgtaccgcgttaccttcgttaatctgcggcgtgactttcagcatgatgccgacttttttcctctctaccgtattgaaaggattgctgttattggaaccaacggtagagccggttaataccggaacgtcctggcccaccatgaagaaggcttcctggttgtccagcgtggtgatactcggcgtggagagcacgttcgagctggagtcgtttttgaccgcctgtaccagcgccatccagtcgcctttcaccacgccaaccgccgtaccgctaaagccagaaagaagctgagcgagcgtggagagatcgccgttagtatccggatttatggtggtagcaccgttttcgctgatcaccgtggaacctttctgcggcttggctgcagaaatcgctgcccccagcgtaccaatagggatttgcgtaccgttggcaaactgcattaatccggcatcttttgacccccactgcacgccgaagttgatattgctgccttcggcaacttccacgattaacgcctcgacatgcacctgagcacggcgaatatccagttgttcaatcacgctttgcagcgactgcatgatgtcctgcggcgcggtaacaatcagggcattactgtgtttgctggcggcgatggagacaacctcacgcccgctaccaaccgtgccttccgcctcttctttagccgccgtgagcgtaccgctgacctgcttcagcacatcgaccagatcttccgctttgctatatttgagatagaacacctggctgttgccgctgcgctccatttctgaatccagccgacggatcagacggcgcattttgtctcgcgtggcggggtcaccactgacaatcacgctgttggtgcgttcatcggcgacaatttgagatttcagcgttgctggctggttctcgccgctgtttttggtcaggctttccagcacgcgggcaatttccgaggctgaggcgttatccagcgggatcacctcttcggtgcgattacccgcgtgatccacgcgctggatcacttccgtcaggcgctccacaacggaggcgcgtccggtaagcataatcacgttggagggatcgtaattaacaacgttgcctgagcctgcgctgtcaatcatctggcgcagaatcggtgccagctcgcgtaccgacacattgcgtaccggcacgactttggtgaccatttcatcgcccgcgtagttgtcgctgccttcaccgaccagcggcagcggctcgactttcacggcgcttgatttcaccaccttcagcacgtcgttttccatcggtacgaccgcatacccctgtgcttccagcaggttaaggaataactggtaatactggcgttcattgagcggagtcatagtgcgaatactcactttcccctgaacgcccggccccataatgatggttttattaaggttagcgccgacggtttcgatgaacgatttcaggtcggtatctttaaaattagcggtgaaagtggcttcttccgcccagaccggtgaactacacaatgccgctgccagcatcagcggcagtaaacgcttttttgttttgaggccagttgtcttcttacgccagatagacaacgtcatatcacgccaaaacacgatgaatgattctcctggattaaatgcggttagcgcagtgcgatggaaatgtcgtagcgcgcacccttgcgtaaaaccgtaagttgaatggaatccattgaaggtaactgccgcatcagagcaatcattgctcgtggatcagtgaaatcctgctgatttagcgcaatggcgatatcgccttccttaaaaccgctggcatcgaacagagaacgatctgcccccggtttcactgcataaccgacaatcccctccttacgcacaggcgtaagctggatatagttaaaaattttctgcggatctttcgccagtgcctgacgcacggcagccgggatctccactggcgcactggcagcaggctcagcaacagcttgctttgcttcgtcactggcggcttttttgctggtcaccgccacaggggggcgttcctcctctgccagactcagacgttccattttcccctgatagcgcagcatcacatggtcgcggttgatttcctcaatcactgcgttgtgagagccaagccgttccccctgcaaatagacctgctgtttgccgccttcttcaataaccgcgccgggtctggcaccaaaggcgatcccacgcagcaccacattaagacgcgtttctgccacaggcgcagattcaggttgttttaccggtgcggcgacgggttgatatttgccaaaccagttttgttggctgactaattgcacgtcatttttatcgaacggttttgcatccgcacggagcggtttattcgccgatgaggaaaccgccgtatattccgcagaaaaggagaaatagcgccagagtgaatacgccatttttgcagaaataataagcagcatcagccagaacatcccgcgcaccatttttcgcagatgctctttgtctgtattaagagattgtctctggctaagagtgtgacgaatttttgtcagcaactgaatgagataaattcgtacgtcacgaaaaacaacccgcgccaatttatatctacccgacgttatgctttgactattccacaggtggtacgatccagtttccgctgatactggttacctgtacgtgtatcattaatcgttatgctgtaattaattccctcggtgatcattaatttcaccgttgggtcagcgcacatttgtcgttgatagctggttaaaaaggcgtcaggtgtctgcgtggtctgagtacccgattcgctgataatggtcatttttaccgtcgtgccactactttgcgccagcactaaggtatatcccgcagatttaatcggcaggttttggctgatattttgcgcctgttttttcgccagtaaactggcgttttcattatggctggcgcagccacttaataatcctgtaacgctcaacaatagcgatattaataccctccctggcatctgttttatcgacatggtaaataatctctaaggttattaataagagttaaaatgtcactttgataatgacgtggttatcattaaaacaatgcctgtagataaagtgttgctataccgcccagacttaaacacggtccaaaaggcagtgtggttgatcctctttttgtaataacggcatatatcaggccgcagcatgatgcgattaaagccacattgggtaacgacaacggccccacccagccacctaacgcagcgaagagtaatacatcgcccatgcctaatgcttctttacgcagaactattccggctatccagcgcagggagtaaaacgtaataaaccccaccagaacgccggtgactgcgtcttgtagcgttaacggactctgctgcgcccatgccgcaatcagtcctgtccacaatacgccctgagtaaaaacatcgggcagccattggttgtcgaggtcgatgatgctcgcggcaatcagccacgcggataatatcatcaccgccagtccccatccactttctggccacaccagactcgccagcaaaaaagcaagtgctgtcaataactcaaccagcggataacgcttgctgattttcgcctgacagtcgcggcagcgccctttgagcatcaaccatgagagcagcggaatattgtcacgaacgcggatagtctgctggcaatgcggacagtgcgaacgcggtagcgcaaggcttatttttgactgcgtactcggcgtttcaccatgaaactccgccatttgttggcgcagcatgatggggtaacgccaaatcaccacattcaaaaaactgccgatgatcaatcctcctgcggttgccagtatgggcatcgccgcggggtattgctgaaaaacatcaaaaagcatggttaaaggttgtttgttgtaatttgccagatgcgggcctgcgggtgtatgccatatggctttcctccaggcccgataagatggcgcatcgggcaaatgtgttaacccgatacgccttatttcatgccggatgcggcgtgaacgccttatccggcctacaggcttactcggcagacatcttatgctcggtaaccttgttaatggtttccggccctttttccggtttcggcagattaagcgacgcgagcgtgctgtaagccgaagagctcacaccgccctcgaagctcatctctgccgctcccggtagctggtaagcattcgcacccggattccatttcttaaagaactccgaaagatccgtctgagcgacccaggaggcacacagcatcagcgtgtcggcagcgttaccattggattcagcacagtaattcttgccaccaaaggtgctgttaccaacatcatcgccgcgtgctttacgatgcatcaactggaacaggttccagcctttcatcccttcacgctcgctgtagaacgctggcagcttgccatctggataccacttcgtgatatcaaagtttttctctgcccactctttcagctgtgcgtacatcagcagacggtcccccgcaccgccgcgcgcccaggcctgaccgttgctctcgtccagatattccggcgcgacggtaatgtcgtcagcgacacggttcatcttgccgagatagcgatcctgcatgtacagcgccagcacgttgttcgccacttcagttgcacccggtacgttcagcggtgtttctgcagcgttatgaccgacttcgtgccaaatcagccagtcgttcagcggcgttgtcggcagcgtggtgctgttcgtcgagaagctgctgttcattaccggataacccgagtgcgcatcaccgatggagatctgcacatcgttggcgaaacggtgtttatgccccgtcaatgcttcataggtaaacatccggtggttaccgctcgtttcattgcgaccgtagaagtcattcatcgagctggcaaaggtatccagatctttagcgaattctgctacaccaccagtgaaattgctggcctcaaggttcttcttcggcgtggtatagacgaacgacgcagactccagctcgcccagcggcgccggtgagtccagatcgtttttccattcgccgtctttatagaacggcgcttttactacaccggtaaaggtgaagttagcagaaacatcatccttactgtcgcccttgatataaatcagaccaccataaggcaccttgaaggtcacttcaccgttagcctccagagtatacgttttagtcactcttggcggacggttcagcgcaacttcatgcttctcacgtccagtcaggtcgtcagccagcgccacggtaacagtcactgggactgacgccgaagacttaatggtgacgtcctgcagggccggtgcccacaggccggttgactgcatgttacccgcaaaccatttggtcggattcgagtacaggctgatgttttccgtaacgctctcaccctttgccgatacggatcctgggtacttctccacatcaaccttaatgttcagatcccaccaggaacggcccagcatcagacgcgtcagcggtttttccatatagttgagcggatagcttgggttcatcatgcccgctttgctgctaccgtcaccgtagatcatgttgttatcgaccagcgattttttcagatctgcggagcacttggtgccgcctgcataggcatcattggcgtagcagttcaggaactcggtgaacgttttaaagcccagctcatcttccttgccctcttcgtaacgatatttcgtatcgttccacagccagaccgacatgttctggtacagacgttccagatcaacactgttcagacgctcacctttactgcctttggtacggaaataaagctcatgctgatacaggcgctgaatgttggtgcctaaatccgccgcctgcaccatcgctttcgcggtgtcggcgtcaagattcagttgcgtatagcgcggaacatacatgccacctgttaccggaacatccgtgcctgggcggcgctccaaacagttaatctcgtaatggtaagtcgagtccttacactcctgtaacccaggaaacttctcaaagatttttgcctttgccgcttccagagattcttctgttgtgtattccgcttcatcaataaaggcataacgcgttacctgtttgccctcaacttcctcctgccagctcgcaacttccagtttcggcttgtcatcaggcttgttgtcttgctggtatttccaggtcacttcccctgtatttgggtcgatggtgtacggcggttgcgcgccgtctgcagcaggataacgttcataaacccaaatgccagtcgcgcgacgctgacgaacgcgatccggatacccttgcggatcgttgttcaccaccgatttgttcagagccattgacagacccgcggcatccagcagacgcacaaaactggacgcgctctcttccttaagattgctcatcacgttttccatgatcagcaccgagccacctttgttcagataagcgatcagatcggtcacatcctgctgagtcagcttcggtttgctggtatctgcacgcagaggcacagcatagggatcgccagaccactgagtcacatattcaaagccgttgaggatcagcaacggaatctcttccggattcagatcgccatagctggtcaactgtttaaccgtgataccagtgaaatcctcatggaaagcaaatggtgcactatttcccaatacctggcccgcttttttgaaataaacgttctccaggttggtgccgacagtcatgatgctcttggtatttggctgccagatgtcatttgacaagtagcgcaggacgttctgcataaagtgcttcatgtcatcagaatcaccgctgagcgtacactcacctttactattaacaccaccgccccaactgtaaccgttcgggcaacgcaggatgctgttgtagtgcgggttaccgataaccatcagtttgccttcaccgacttgccccagcgaaataaacggcaggttgaaggtcgcggtatcgcgcgtaacgttctctggctgcacaatggaaggcgcttccgtaatgtacgccagctcatttttatcccaggcgcgtttttcgccaaacgccagccagtagtttttatcattacgcgccatcagaatcgggaatgccgcgttggagatatttaccaccgcctgaccgcgcgcgttaccggtgctgccatagaagttggtagagtcatggaagacgtggaacttgctgacagactgatagttcgtatccacgccccacagcttgttaataacgccctgaatctggccgtcattaacattgcgcgttgtcagcgagaaccagcgagcctcgttgcaaccgtcggttttcgcacaaatcgcggtatcgatctctttggcctgacccgtcttaaactgctcgataaattcgttaggcagcacaacgttttgatcgccttcatccagcgtcgcaccgttggataacgaaagattgattatctcgttgatcacgttgggatattcggcaaagaccttgcgtacatcgtccggaacaacacgagtattattttgaccagtcgtcgaataacgatgaatgagctgatcgatatttgccccgcgaacttcatcacccaattcagtcagcgcaatggtcgacttattgccacgtactgagcccagttcaaaggtatcgataccaaaggagatggtttcgccccagctaaaggagaatttaccgttttcgtcagttacgccacggccagaattggtgtagtagtcaacgccagcaacaccgttccccaggctatccaccagttggccttcggaaagaatgatttcagtgggttgatactgataaaactgttccgcgttagccgacacgaaggacgcgttcagatccggttttgttccctctgtcgtgactggcactaccgttgaggtatgggtggacggcgctttatcagtcgcagcattgttttccacctcttcattgaccagcttgctgaaattgtctgttgccagatcaatttgcttatacagtttttcaaatcgcgcgcgatcaaccactgacgagaaagtaagacaaagctgttctgcatctgcggggcaactgtcgctggacgtcaccagagagatggcgttggttttcttattttcagaattcgccagctcctgtgcgtcctccaggctaaacgacactttgtcaaccgcacgcaggctacgcgcagcttctgactgggtgttgaatgttgcaatggtcgtactgcccaccacacaactcacggtattgcctggcgtaaaggtaaagccatcgctggattcaccattacaggtagcaccagttacccgctggcttccacccagggtcagataacccgttttcgtaggaacaggttctggctccggttctggtgtcggctcaggatcaggtgttggatccggcgtaggttctgggtccggcgtcggctcaggtgtcggctccggggttggtgttggatcgggtttcacttccggcaaagtccctgatccagaatctacagacggcgtatcggaggacgatcctgaaccaccaccatcacaaccggctaacagggttgcgcttaaaatagccgctaaaagcgatttcttatatttaaatttcttattcattaataacgcaagtgacaaaacaaagttaaaagattcgtaaccgaggaaatagttttatgctttatcttctttaataacttcctccattcttaagaaaacggcatcattgatagaaaaacaggtaaaatttataagaataacccctattcgatgtctggatggttatttttacgaaatttcaataaacaaaaaattaacaaccattcacaacgtaactatataaatttgttggtagttttaacgattaagattgcaaaagcaacagatagaacggagtttgctcatcaagcgaacataattaatacagacttgttttgcgtgataaaaaatagatgttctcacgctcttaattatttagcatgttatctgaacgcaaaacattattgccgcatggataataaagcgggaaataattttccattaataagacagaataatgtaaacgaagccggatgatattaacgatcatccggcattattgacttacgaaactaacatcccggtaaacacatacgcctgcaacagcgtgataatgccgataacgctggcaaaaatcagactgtgcttcacggtgtagcggaacagttcagattctcgccccaccatgcccgtcgcggcgcaggccacggcgatagattgcggggagatcatcttgccagttacgccgccgctggtgtttgctgccaccagcagggtgtcagagacgttgatttgctgcgccgtggtcgattgcagtgaaccaaacagggcgtttgaagaagtgtccgagccggtaaggaatacgcccagccagccgaggaacggtgagaagaatgggaacatcacgcctgtaccagccagtaccagcgccagcgtggtggacataccggaatagttggtcacgaaggcgaacgccagcaccatgccaatcgacaatatcggccacttcagactaattagcgtttcggcaaagacaccaatacctttcttgatccccacgccgaggatgaagatcgagataatcgccgcaataaaaatagcggtgccgccagcggagagggggtcgaatttaaacaccgcgtccattggcgtcggctgggcgacaatgggggccgctttcaagacttgttgatgcaaatgagggatctggaaattaatcaccagtgaataaaacgcgccgcccggagcaaataacgctttaaacggcttcatggtccagatggtgaccaacaccgttaagattaaaaacggtgaccacgcacgaatgatttgccccagacgatattctgaaggcacgggaccgccagaagacggtttattcaccaccatcgcacctgcggattgtcccatactgattgccgtttcggtattttttggccgccagactttaagaaataaagaaagtgagacgatactcaccagcgccgaagtaatatccggcagttccggaccaatatagttagaggtaaagaactgagtgacagcgaagcttccccctgcaaccagcgccgctggccacgtctctttcacccctttccagccgtccatcattgctaccagccagaacggcacaagaaccgacaggaacggtaactgacgtcccgccattgcgccaatgtcgaacggatcgattcccgttacctgaccggcgaccagaattggcacacccaacgcaccaaacgccaccggcgcagtgttggcaatcagacacagccccgccgcgtatagcggtttgaagcccagacccaccagcagcgcaccggtaatcgccaccggtgcgccaaagccagccgccccttccagcaacgcaccaaaggagaaaccaatcagtaacacctgcaaacgctgatcgtcggtgatggagataaccgagctgcggataatatcgaactggccgctggcaacggttaatttatacaggaataccgccgcgacaataatccacgcaattggccataaaccataaataaagccatagcccgcagcagcaaatgccatatcaatcggcattttaaaggcgaatatcgcaatcagaatagataatataagggttattgctccggcgacatgtcctttcagacgtaataccgcgagtgcaacgaagaagaatattattgggatcagggcgaccagagcggatagccccagtcctcccatcggcatatacatttgggtccaggtaaccatattgttcagtctcttattatctttatatgcttgatatacttaaggttgtaataagcaaaagaggactgaactgtaaaatataggcgttatactttacagcaacagtacgccgctaacgcaattgctacctctggcataacaagtatatcgggtaagggtttctgttccgcacacgcaggcgcagagtatcgttaagatgtccatattgttgtattaatcccgctagtgatgcgctacgggtatttaatattgttaacccctgataatcgctccggttatttccgggataaatgtactaccgcagttactatcatagccccgacaataaatcttgccggggctttttttgacgctattaatgattttctttttcgcgtaaacgccatgcgtgtaataacggttcggtatagccgtttggctgtttcacgccgaggaagatcaaatcgctggcagctttaaaagcacacgagttagcgaaattctccaccattggacgataagccggatcgccagcgttttgctgatcaaccactttcgccatattctccagcgaggcctgcacctgatctttggtcagaataccgtgacgtaaccagttggcgatatgctggctggagatacgcagcgttgcgcggtcttccatcaacgccacgttgtgaatatccggcacttttgaacaaccaatcccctgctccacccaacgcaccacgtaccccagaatcccctgcacgttgttatccagctcttgttggatctcttgcgccgaccagttagcgttttcagcaaccggaatagtcagcagatcgtccagcagcggttcaaattcagcattgaactcggtctgggcaatgttggcttgcacgctctgtacgttggtttggtggtagtgcagcgcatggagcgtagcggcagttggcgacggaacccaggccgtgtttgccccggcacgcaattggtcgcccttctggctgtacatgtctgccatcaggtccggcattgcccacatgcctttaccgatttgcgcttttccacgtagcccacagaacagaccggaaagcacgttattacgttcgtaggctttgatccacggcgtcgatttcatctggtttttacgcagcatcgggcccgcttccatcaccgaatgcatttcatcgccggtacggtcgaggaaaccggtattgatgaacgccacgcggttgcgcgcctgagcgatacagctacgcaagttcagcgaggtccggcgttcttcatccataatgcccattttcagggtattcggtgccataccgagcattgtctcaacgcgggaaaacagtttgttggcgaacgccacttcctgcggaccgtgcattttcggtttcacaatatagacgctgccagtgcgcgagtttttctgcacttttaaatcatagagggcaatcgcgccagtcatgacgccatcaagaatgccttccgggatttcattgccttcgctgtcccaaatcacaggaatggtcatcaaatgccccacgttgcggataaacagcaacgagcgtccgtgcagagaaatttcagatccatcggcggcagtgtactgacgatcgtcattcagtttacgcacgatttgccgaccgttcttctccattttctcttgcagagtcccctgcatcaggcccagcaggttgcggtacagcaggattttatcttccgcatcaaccgccgcaaccgaatcttcgcagtcgagaatggtactgatggccgcttcgacgataacatcgttgatgtgcgccggatcgtctttgccaatccgcccgttggcatcgatttgtagctcaatatgcaggccgttatttttcagcaaaatgcaggtcagcgcagcagtatcgccacggtaaccgacaaactgtgctggagtacgtaacgtggtttctttaccatttttcaactggatgcgtaattgtttatcgaccaccttaaacgccaccacatcctgatagctgccgttttccagcggtagtgattcatcgaggaaacgccgaacccaggcgataacctgctcaccacgctgcggatcgtagccgctgaccatcgccccttcctgcgggatgatgtcgctgccgtataacgcatcgtacagtgagccccagcgagcgttcgccgcgttcagcgcgtagcgggcgttcatcgccggaaccaccaactgtggccccgcctgactggtgatttcgctgtcgatgcccgtggtttccaccgtcacgtggtcaggctgtggcaccaggtagcccagttcacgcaggaaagatttataggccgctttatcttttaccggccccggattgctgcgatgccactcatcaagcgccgcctgaatgcgatcgcgctctgccagcaactgacgattctctggcgccagatcgtgaacgatctcatcaacattgtgccagaacgcggcagcatccagttccacgccaggcaaaacttcttcatccacaaaacgtttaaaattggcgtcaatgcgtaaacggccctgggttatggtttgactcattgtttatctcctcgttttcgcttatttcgccaacaccgctgctgccgctttcgcgacctgcgcatcctgtgctccggttaaaccagaaacgcccacggcaccaataatttgcccatccacaacaaccggtacgccaccttccagcgacgtcagtaacggcgcagtcacgaacgcggtacgtccgttgttcaccatctcttcatagcccttagtttcacgacgccccagcgcggcggtacgcgctttctcctgggagatgtaagccgcaatcggcgcgcaatcgtccatgcgacttaacgccagcagatgaccgccgtcatcggcaacagcaatggaaacagaccagttatttttctgcgcctcttcctgacctgcggcaataattgcactcgccatttgctggctaagaatgactttagttttcattttgttattccttttcaagggcttgttctacaatttcaatccagtgacgcacagaggtacgaccggcgctcgccagatgcgtctggcaaccaatgttggcggtgacgatcatttccggtttgccgctttccagcgcattcattttgttatcccgcagctggcgtgccagatcgggatgcgttaacgcatatgttcccgctgaaccgcagcacagatggctgtcgggaacgtccgttaaggtaaatccaagacgaagtaacactttttccacttcgccgttcagcttttgcgcatgttgtagggtacatgggcagtggaaggccagttttttatcgccgcgaattgccagtttttccagcggttcctcgcgcagaagttcgactaaatcgaccgccagctcactgacctgacgcgctttatcggcatacaacgcatcgtttttcagcatctgcccatactctttaacgaacgcgccgcaaccgctggcggtttgcaaaattgcctcgacacctgcttcaatcgcgggccaccaggcatcaatattattgcgcgcccgcgccagccctttctcttgcgcattaagatgatagtccaccgcgccacaacagcctgcttcgttagctggcgtcacgctgatccccagacgatccagcactcgcgcagttgccgcgttggtgttgggcgaaagcgtaggctgggcgcagccttccagcattaaaacccgacgcttatggcgcagcggcggacgcggtttagctttcaccgtttcagcaggcagttttgctctgacctgttccggtaaaaacggtcgcagcaccagccctacctgcgtcagcgcacggaagaccgccggacgcggcactacctggcgcaatccttcgcgcagcattcgctccggcagtgggcgtttcactttctgctcgacaatatcacgcccgatatccagcaaattgtgataacgcacaccagaaggacaggtggtttcacaattgcggcaagtgagacagcgatcgagatgctcctgtgttttaagcgtgacttcgttgccttccagtacctgtttaatcagatagatgcgcccgcgcggcccatccagttcatcgcccagaagctgataggttgggcaggttgcggtacaaaatccgcagtgaacacaggcgcgcaggatgctgtcggcttccagcgcgcgcgttctgccgcatctcttctgttaatcgggtttgcatagcctgctcctcaaagttccgcgtacatgcgaccggggttaaacacgccgcaaggatcgagctgctgtttaagctgctggtgatagcggaataaaggtgccggtagcggggcaaagccaccgtctccggcactaaagcgggtcgcatgaccgcccgcgttgcgggcgatgcgatggatttgattatcatcggctgtcgatttcagccagcgtaacgccccgccccagtcgatcagttgctcgccgggtaaatccatcatcggcgcatcactgggtaatgaaatgcgccataaggtacctggtaacgagaagaacggcagttgttgttcacgcaattgctgccagaactgacctgcaacctcttcgccacccagcagttcacgcgctgcttttaccgatccttcgccgccctcaaggcggatccacaacgcattgtcgaagtaacataagccactaatgggtagcggctggagttgccactgggcgatttcattcatggcttcttgcaggctgatttcccgacgcaggctcagggaggcgcgcggtcgcggtaacactttcatcgagatttcagtgagcacgccaagacaaccgtagcttccggccattaaccgtgagagatcgtatccggcaacgtttttcatcacttcgccaccaaaacgcagatgttttccagtgccggtaatgatgcgcgtgccgaggacaaaatcgcggaccgaaccactccacgggcgacgcggccccgccagcccgcaagcgaccatcccgccccaggtggcttcttcaccataatgtggcggctcgcaggggagcatttgcccggcgctctccagcgccgcttcaatcgccaccagcggcgttccggcacgcgcggttatcaccagctcggtcgggtcgtaattaacaatgccgcgatgacaacgcacatccagcgtttgcccggtgacaggacgacctaaaaaggctttgctattgctgccctgaatcaccagcggcgttttatcgctaatcgcctgattcacctgctccagcagcgcctggctgtaatcacactcgcgtagcatcagaaacgctccagttcagggaaaggtaaatgaccgtgatgcacatgcatggcaccaaattcagcacagcggtgtagcgtgggaatgtttttcccagggttcagcaaaccatcgggatcaaacgccgccttgacctcatggaaggtcgtgatttcatcgctgttgaactgggcgcacatttgattgattttttcgcgcccgatgccatgttccccactgatgctgccgccaacttcaacgcagagttcgaggatcttcccgcccagttcttccgcgcgggcaaattcaccgggttcgttggcatcgaaaaggattaacgggtgcatgttgccgtctccggcatgaaagacgttggcaacgcgtaaatcatattgctgcgataaacgggcaatgccttccagtacgccaggcagggcgcggcgcgggatggtgccatccatgcagtagtaatccggggagatacgtcctaccgccgggaacgcatttttgcgaccggcccagaaacgtacgcgttctgcttcgtcctgtgccagacggacgccagtcgcacccgcgttcaacaagatgtcgttaacccgctcgcagtcttcctgtacgtcagactccacgccgtccagttcgcataacaaaatcgcttcggcatcgacgggataaccggcatgaataaaatcttccgccgcgcgaatcgacaggttatccatcatctccagcccgccggggataatgccattggcgatgatgccaccaaccgcaagtccggctttttctaccgagtcaaagctggctaacagaacccgcgccacgggcggcttcggcaacagcttcaccgttacttcggtggtcacgccgagcataccttccgatccggtaaacagcgccagcaggtcaaaaccaggcgaatccagcgcgtccgatcccagcgtcagcgcctcgccatccagcgtttgcacttcaattttcagcaggttatgtacggttagaccatatttcaggcagtgaacgccaccggcattttccgccacattgccgccaatcgaacaggcgatttgtgaggacggatccggcgcgtaatagagattatgcggcgcaacggcctgggagatcgccaggttacgcacgcccggctgcacgcgcgcgcggcgaccaatggggttaatgtcgaggatctctttaaagcgcgccatcaccaacaacacacctttttccagcggcagcgcgccaccagaaagcccggtgcctgcgccacgggtcaccaccggcacacgcaggcggtggcagacagccagaatcgccgtcacctgttccatctgcttaggcagaacaaccagtaatggacgcgtgcgatacgcgctcaacccgtcacactcgtaaggaatgatctcctcatcggtatgcaggatctccagtccagggacatgctcacgcagtgccatcagtaccgatgtgcggtcgacttcgggtaaagcgccatcaagacgctcttcgtacaagatgctcatgagtagggttcgctttgttgtgttgtgtggcagctgattttttcgcgctgcttctgtgaacagttattaagcgggcttttcgttttcgtctatctctttagctaccggtcagaccattttttttccagctctgtgaccttgctttggttaacttaatgttaaattgatgtaacataatcacttacgtgatgtgcgtgttttgcgagttaagaacagaaaaattggtcctacctgtgcacgaggtccgggaatgaaagatgaacgtcgccctatttgcgaagtggttgcagaaagtatcgaacggttaattatcgacggcgtactgaaggtcggtcagccgcttccctcggaacgtcgactgtgtgaaaagctcggcttctcacgctccgcactgcgtgaagggctgaccgtgctgcgcgggcgcgggattattgaaacggcgcagggtcgcgattctcgtgtcgcacggcttaatcgggtgcaggacgccagcccgctgatccatctgttcagtacgcagccgcgaacgctgtacgatctgctcgacgttcgcgcattactggagggcgaatcggcaaggctggcggcaacgctgggaacccaggctgattttgttgtgataacccgctgttatgaaaaaatgctcgccgccagtgagaacaacaaagagatttcgctgatcgaacatgcgcagttggatcacgctttccatctcgccatttgtcaggcttctcacaatcaggtgctggtgtttacgctgcaatcattgaccgacctgatgtttaattcggtgtttgccagcgtaaataatctctaccatcgaccacagcaaaaaaagcagatcgatcgccagcatgcgcggatctacaacgcggtgttgcagcggctgccgcacgttgcccagcgcgcagcacgcgatcatgtgcggaccgtgaaaaagaatctccacgatatcgagctggaaggccaccatttgattcgctcggcggtgccgctggagatgaagcaggggtgactgccatcaaatctgcttttcatacaatcggtaacgcttgtacggctccgccccaatgcgttccagcatgttattcatgcctgtattggtttcgaggatccatgacatttccagcgcatcgatcttccggcgggcaaacggatcgcgtaaggcttcaatcaataacagcgcaatcaccgggccgatgcggctgaactgatactcgtcccgcacgcccatcagcggcactcgcgcagttcgcacaccgctgactttcaaacgccacagcaattttgcccagccgaagggaaagagcgatccgttcagatcggcaatcgcctcgttgatgttcggcaagccgacaataaacgcgcagggtgcagaatcaatctcagcgatgtagatcatatcgtccggcaccagatatttaagttgatcgcccatggtcgcgaattcatgttcggtaaacggcacaaatccccagttgtgctgccagccagaattgaaaatctcacgcaggatctgcatctcttcggcaaaccgctggcgattgatgcagcgaatggtcacttttttgcgcacctgatccatcagtttttttagcgccggagagaaagtgagatcggttcgctgcatccaccacgccagtaaatcaatgcctttgtgataacccagttgttcaatatgcgcggcataccacggtttgccgtgtggcatcatcgcacagggaggtgtgtcaaaaccttcaatcagtaatccgctttcctgattgatattcaggctgaaaggcccgctgatcttacttgcaccttgtgacttcaaccacgcctccgctgcgccaaacaacgcggcaaaaacctgcggatcatcaatggcatcaatcattccgaaatgaccggtatcttcaccgtaacactcacggtgcaaggtatctatttgcgcggtaatacgcccaactatctgccccgctttttttgccacccacgcctgccagatgatatggtccgtccccggattcttcgcagacaaatgctcgctgcgttcaatgaataaagggggtatccagtttggatcatcgggataaagtgatgacggaaaagcgataaatgccttaaggtcttttttattaattactttttcaattttaatcatcagcagatcgcattccatatctctgtggataacaaataattaacggtgaaaaacaagttgcaacagcaacgaacggcatcttaataatcaacccaatgaatacaaacaaagaataaatagtatttattaatgattacgataaggtcagagactacacagaagcgccacaatgccttttgtcgatttaaggcgaccggacaaggctccttcttaatatattcacaaattaaatatcattcacaataaaaacaaaaaagccaaacctattatttaaatcaatgttcattttcacaccgatgaaaatactatctcatttatcttttatgcctatataatccaccgcattattgtcattttatttttgatatccaattttttcgtggtgtatatgtctaataaaatctttacgcattccctacctatgcgctatgccgattttccaacgctggttgatgctttggactacgccgctctgagtagcgccggaatgaatttttatgacagacgttgccaacttgaagatcaactggaatatcagacgttaaaagcgcgtgccgaagctggtgcgaaaaggttgttatcgctgaacctgaaaaaaggcgatcgcgtggcgctgattgccgaaacgagtagcgggtttgtagaggctttttttgcctgccagtatgccggcttagtcgccgtcccgttggcgattccaatgggcgtaggtcagcgggattcctggagcgccaaactgcagggtttactggcaagttgccagcccgcagccattataactggtgatgagtggttgccactggtcaatgccgcgacgcataacaacaaccccgaattacatgttttaagccacgcctggtttaaggcattaccggaagccgatgttgcgctccagcgtccagttccgaacgatatcgcctacctccagtacacctccggcagcacccgttttccccgtggcgtcattatcacccatcgcgaagtgatggctaatctacgtgctataagccacgatggcattaaattacgccctggcgaccgctgcgtctcctggctgcctttctaccatgatatgggactggtcggctttctcctgacccccgtcgccacgcagctttcagtagattatttgcgcactcaggattttgccatgcgtcctctgcaatggcttaaattgatcagtaaaaatcgtggcaccgtttccgttgcaccgccgtttggctatgaattgtgccagcgccgcgtgaatgaaaaagatctcgctgaactggatctttcctgctggcgcgtcgctggtattggcgcagaacccatatccgcagaacaactccatcaattcgctgaatgtttccgacaggttaactttgacgataaaactttcatgccgtgctacggactggcagaaaatgcgctggctgtcagcttctctgatgaagcctgcggggttgtggttaacgaagtggatcgcgacatcctcgaataccagggtaaagccgtcgcgccgggtgctgaaacacgcgccgtatcgactttcgtcaactgcggtaaagcgttgcctgaacatggcattgaaatccgcaatgaagcagatatacctgtcgcggaacgtgtggtaggccatatttgcatctccggccccagcctgatgagcgggtactttggcgaccaggtttcgcaagacgagattgccgcgacgggctggttagacaccggagaccttggttatctgctggacgattatctgtatgtcaccggacgcattaaagatctgattattattcgtggccgtaatatctggccgcaggatattgaatacattgcggaacaggagccggaaattcattctggcgatgcgattgcttttgttaccgcccaggaaaaaatcattttgcagatccagtgtcggatcagcgacgaagcacgtcgcgggcagcttatccacgcgctggcagctcggatccaaagcgaatttggcgttaccgcggatatcgatctgttgccgccccacagtattccccgaacatcctccggcaagcctgcccgtgcggaagcgaaaaaacgttatcagaaggcttatgctgccagtcttcatgtgcaggaatccctggcatgaatcaaactgtcgcggtgacgggcgctaccgggtttatcggtaaatatattattgataacctgctcgcccgcggctttcacgttcgcgcattgacgcgtactgcccgcgctcacgtcaatgataatctcacttgggtgcgcggttcgctggaagatacacattcgcttagcgaactggttgccggagccagcgcggtggtccattgcgccgggcaagtgcgcgggcacaaagaagagatttttacccgctgcaacgttgacggcagcctgcgcctgatgcaagcggcaaaagagagcggcttttgccaacgttttctgtttatctcttcgctggcggcgcgccatcccgaactctcctggtacgcaaattccaaacacgtcgccgaacaacggctgactgcaatggctgacgaaattacgttgggcgtttttcgcccgacagccgtgtatggtcccggcgataaagagttaaaaccgctgtttgactggatgctgcgcggtctgctgccacgacttggcacgccagagacacagctctcttttcttcacgtcaccgattttgcgcaagcagtgggtcagtggttaagcgccgaaactgtacagacgcaaacctatgaattatgcgatggcgtcgccggaggctatgactggcaacgtatccaacagcttgttgccgatgtccgctgtggttccgtgcggatggtcggtattcctcagccgctactcacctgccttgcggatatcagtaccgcgttgagccgtctggcgggtaaagaaccgatgctgactcgttcgaaaatccgtgaattaacccatgccgactggtcggcaagtaataaccgtatttctgaagatattaattggtttcccgggattagcctggaacacgcattacgcaacgggctattttgattgtcttgtttaaaggtgtgttaacgtttctatggtaaatcgtgaaatagtaatggattacatcctttcctgtttacaggatttggtcgaaaacggtgtggaaattaagcccgacagcgatctcgtcaacgatcttggcctggagtcgatcaaagtgatggatctcttaatgatgctggaagacagattcgatatttccattcctattaatattctgctggatgtcaaaacccctgcgcaattaatggaaactctacttccatggctggagaataactaatggggctatacgataaatatgcgcgccttgctggcgagcgcctgcaatttagtgacaacgggttaacaccatttggcacctgtattgatgaagtgtattccgccaccgaaggccggatcggcaataaaaaagtgattctggccgggaccaataattatctcggtttaacctttaatcatgatgctatccgcgaaggtcaggcagcgttagcggcccaaggcaccggcaccaccggttctcgtatggcaaacggcagttatgcgccgcatctggcgttagagaaagagattgccgagtttttcaatcgccctaccgctatcgttttttcaaccggttataccgctaatttaggcgtcatcagcacacttgccgaccataacgccgtggtgttactggatgccgacagccacgccagtatttatgacgcctgttctctcggcggcgcggagattattcgtttccgccataatgacgtcaacgatctggaacggcgcatggtccgcctcggtgaacgggcgaaagaggcgattattatcgttgaaggcatctacagtatgctcggtgacgttgcgccgctggcagaaattgttgatatcaaacgtcgtctcggtggttatttgattgtcgatgaagcacattcgtttggcgtgttaggcgctacggggcgcggactggccgaagctgtcggcgttgaagatgatgtggatattatcgttggcaccttcagtaaaagtctggcctcgattggcggttttgctgtcggttcggaagcgatggaagtgctgcgctacggcagccgcccgtatatttttaccgcctctccttctccgtcctgcattgcgaccgtgcgctcgtcgttaagaaccattgcctcacaaccagagctgcggcaaaagctgatggataacgccaaccatctgtatgacggtctgcaaaagctgggttacgagttaagttcacatattagcccggtagtgccagtaataatcggttcgaaagaggaaggtttacgcatctggcgcgagcttatttcgctgggcgtttatgtgaatcttatcctgccacctgccgcgcctgctggcatcacgctgctgcgctgtagcgtaaacgcggcccacagtcgtgagcaaatcgatgccatcattcaggcatttgctactctgaagcagtaatgtgaacccgccgtggtgttgcgccacggcgggtttaatgttgtctgtcatgccaatacaccaggctcaacgccaccagcacaaacgctaccggtaaaccgagcgcggtaacaggtgcgctcaacgcaaatagcaatcccagattgaccatgatttgatagctgatccaggtgagtaaaccaacgatgacgcctacagcgagacggctacccatccctggcgagcgcggggcactaaaggtaaacggcacagccagcaaaatcatcgccagagtcaagatgggttgccccagtttttcccacagtgcaaggcggtattcgctgctgggttgcccggtttcctgcaaataatggatgtaatgattaagctgacggacagaaaaagtattccccggcatcgataactcttcaagattcatactggtgaaggtcgattgccaggcaagattatcagatgtttccagcgtttctttgccattcagccattttttatgattcacaccatgcaggatccacgttttgtcatctttaatggtggcactgcgcgcataaatgtaggattcgagcgagagatcgtcgcggtaatgaaaaatctccacgcccaccggctggccctgctcgttcagcgatttcaccgtcacaaattcattaccgcgcctggcccaaagcatattgccgataatgtcattgtcctcccccaacgcggtggcagtcgatttgatttgcagcgcctgttgctgcaatggtgacgccacccactcatcaatcgcgcctaacgaaacagtccacagtatccctgcaaccagcgccaccagtgcaatgcggaagatagaaaaccccgtgctgcgaatggcggtaagctcactgtttttcgataactgcccgagaccaacaatcccccccaataacgcgataaacggcgaaagttcgaccagtgtgcgcggtaaggtcatcagcaccaccagcactgcctgagtccagcgataaccgcccggactgacatcatccagttcgttaatcaggttgaaggtggtaaaaagcggcagcaatagccctgcggcggcggcaaaaccgagaaagaggtgacggattaaatagcgactgaaaacattcatcggggaaatttctgcagcaaggagaagtcgcgtgcgaccagcatcaacaagcccattagcatgagtccgggcactaaccacaaaccaggaatgaggggaatcgcgccgttagccaccagcgtacgacagacgtcgccgccataaaaaatggcaacaaacagcaacgtcagtggcagtagcgttgaaaatcgcccctgccgcggttttacccgacttaatgaaatggccagcagcgccatcaacaatgctgtcaggccacggctttgtcgccattgcagttcggcatgatcggctggaaagacggagcgtgccagctccgtgaccgattttgctttgcgtttgacgttagggctttgatccagcggattgagatgcaattgcagattacggtagatctgttcgttgtcgtcacgcccctgatgatcgagaagataggcggtaccgttatgcaacataacggtcggtttctcgggtgatgggtcaaccacatcaaccgaacgggcgcggaaaatgcgggttcgattggcagtagaagtataaatcagcgcgtcagtcaggcgattattatcctgatcaaccgtctgcgaaaggatcattcgtccgttatcgttagtgttaaatttctttgcccgcaactgacgaacatccagctccgactgcgattgttgctccagttgataaatctgcgcataagcccagggacgaccatacatcgacagaagggtgacaaaaatacttagcggtatcgccagataaaggacggctttgtacaaacgtcccggactgccccccgccgcggagatagcggtaatttccgagtcggtatacatttgccctagcgtcacgccaactgacgcatacagtccaacaggtaacagcatctccagtgcaatcagcactttgtagaaaacgatatccagcacaacatcaagagctaatgtcccatttgccgcttcggtcagataacgctgtgcggagtagctggcgaaaataaagatcagaaaaccgacgataatcagcaccagacggcgcgtaccacgcatgatgtagtgttcaaccagcttcatctcgctaacgccctcaatcctttgaattttttattcattgatcagtttctgcgccagcgcaatgacatgatctacctcttccggtgtcaggctgccgtcctttgcccactgaattcgcccggctttattcaataccagaatggttgaactctgctccggcaattgccaggcaacgcgtcccagaccattgccgtcaataacgaattgcgcccacggatagcggcgtttatttttttcgattttgccaacgacaaaatagccagtaccaaagatggcatcatcggtgttcacaatagtggtgggctgaaaacgatcctgcgaaaagtttgccgcttcaaccgctttaattaacagtgagttctttttcttcgcagacttacgtccggcgatatactgaataatgcggacttttcccgtcaattgtgtgctgttccacttttggtagtgaatttcgtcgtcgctattcagaagcagctcgccgccttcctggatataaacaggagtaaccgttttgccagtgacgaaattgtgtgccgccgcgcctggcgctaagagtgcgatgatcagagcgacaatccaacgagatggcattattgctccggatatagtgggaaacgcgaaataagcagttttaaacgctggcgaatatcgctatccagcgccaccggtgcatcatatgaccgacggttatccatatcatccgccaccatgtcgtcgtgcttatcccccatcagaccattaatggcggcgagaaaacgggaaatcagtaacgcctctttattttcaggatcaagcgatcttaaggtgtcgtaataagaaacctgctggctgatgatttttcgcacatcatgaaattccctgccagttagttgcggtttagcaataatctctttcaggatgtacatttgcttctggcggtaggcgataaaaccgttcacggtttctaagtggctatggcgcaatgaatagttcaccagccaccagacaggggagctcaaataaacacgtaacaggttaccgtaaaacgacacaatatttttcttaccgttacgaaagccatcctgaaaatgcccaagaaaaacggtcgttttgccgaataaaaatccggcctgatgcttctttaaatacagccgttgcgcaaaacgcagatgcttgtagcgcgctcgcatgtatttaaactgtttgcgctcgtctgtcgtcagctcatcgcctttcgcctgtttgcggattaaacgcagtaactcctgacgattaacaccatccagccagaatttcaggcataacgcgtaattatcatggatgatttcggtggtacaacttagtgcgatagtcggcggcaaactgacctgtgcatcaacaacatcatcttcttcaatcgcaacaaatagacgctcgctcgcctcaagcgggaaatattttctcatcatcaggatttctctccggttgagttataaagcaaggaatggcgctgaaaaaatgcctttaaggtcggaattagcgagagcaccacatccagacattgcccaccgaagtaagcaaatgcagcccccagcacgccaaacagatgacagaacatgaacagcaatacgatgtagccgattgaggcgatggtttgcgccacgagaaaagcgcgctgttttcccgccatcaatagcaatgactcctgtgggaagcccagcatcgaaatcacaattgcgcccagcatcacctgaatcaggtcatacgcttcgagatacttaacgccaaacaccagcgaaatgagcggcttgccgacgatcaacaccgcgagcgccaccagaataccgattccgcccgccagtaaaccggacttcacgcctaacaaccacggtctggtggtgcgtggatctaaacgcatcacctctggataaaaacttttgcccagtaaacccgctggcgttccggcggcatcgaagaatgtcatggcgattttaaataacccggcagcagcgggtcctaacacgatccccaccaacactgtgctgcacgagttacgcgccgaccagatggagtgggcaatgttggttgaccagacaaaactccacgcgcctttaatgtgtcgggcagactcaaacagattcaatttgaaggcgttatggatatttctgcggcgtaattcgcgcgcggcaaaccaccagtacatggtgccgccaaccagattcgacacgtaccaggcaataacaaaacccgcaaaaccaaagtcaaaataccaggctacgacgctccccgctgcgcgcagaaaaggtttcgtcgcctgctgtacagcaatcaaatcaaagcgatctaccgcacgcagaatgccggtcggcgtggaggaagccattgaaggaatgagcgtgcaatagagcgccgccagccaaaagctttggtcatccagacctaatgaatgggaaaggaatggcagtaaggcaatgccgccgacaatcgccaccgcgccgctgacgatatccagcgagaaggaaaatgagacaacattgcgaaattgctgcggatcattgttggtcaaagctggcgttccgtactgaaccaccagctgccatgtctgaaacttaataaaatcgctgatcgacttggcgtacgattgcacaattaccagtacgccaaacatggcgggcgtcatccctttaccggcacacgagagcgccaacagccccagcaaagcgctcacaacattactggagcctaaccaggcgctattgcgaataatggtgcgaaacgcgccatctgcaaaccaatgtttgatgttaaaaaccgccaattcagcctgaccttatcgttgatagtaaaaagtatcccgccagccttaagttaaacttcggcggtcagaaacgatggcaaccagagaaaccgccttctgtgcctgttccagcacctcgctgtaaggcgctctggaatcaatctcaagaatttttgtgccgttatagccaatcgtcgacatgacgccgattttgtcctgcagctcggcatagtcatggtcaggcttgcgggagatggcagtatcaatatcaatccccaagcgaatgattaattcaggacggtattgcgccattttttggtataaacgccgttcacgctgcgccagaaacatgctgattttcccggtcgcacgttcgacgccaatccccggtccgtcataataaaagcccgaaatttcagcctgcgggaagcgatcgctgaccaccagaacgccactttgcgccagtcgctgaaccttgcgcagattcgccattcttcgcagcgagaagcagtacataatcaccgccgcccatagcgccggagatttggttttcatgctttgggttttcgaggatttggccgccagtcgccgttcgagccagacaccaaccaacggcaatcgtttgattttgtcgccgtcttcgccggagagcagccccagatagcgccgctcggtttgccagtgttgttgcagcgatttcaccaggtcatttgtcagtgtggatttaccggttccatcacacccgaccaccgcaatcagccccggaatgtagttgggctgcggcgcggttgtactcttaacagtttgtgtttgtagtgcatccattcgtttaatcatcccctatccattttggtgatcaggaaagcgcggcgtgaattgcgcgtagtgacgcttgcagaatttcatcggctggttgccgaccatccagttcaaggatcctggcgccattgaatgtcagttgcggcgtaacggcgattttttcctgtaacgctgccagttggtggtcaggtttacgcgcaaacgcggtttgttcatcaatgccaagacgaatcaacaatacaggcaaataagacgccatccattggtacagcttcagctcacgctgccttaacatttttatccaaccgttaccgcccgtggtttttgccaattgcgggccatcaaagcggaaacccggcacttcaacctgcgggtagcggtcggtgatgagcagatagccttgctggtttttacacaacattttgcgaaacttgtacgcccgccagcaggaaagcagatagataaccagcgcagtaatattgccaggcggtgttgagggcttttcgtgcacatgtgccgctttacttcgcaaataacgcccaaaaggtgcgccaataacaggtagctgtgaaatccattcgccaattcgcccggacgattgcccgagataaatgtgttctgttggcattcttgatgccagttcatttaccaggtttgccgtgaggctcgatttacctgaaccatcacatcctacaatggcaataacacgcactggcgtggaattaattattgacatattacgttgattcacgaaaaacccggcagcaaataatgtattgaatattacgtggtccgtgctcagaatatccgttcaaccttattgtgacaatggttaattgtgacattaacctgaattacgctttcatcaaaaacatattaaccaaataaatattttggatggatatttaaatttaaggatatattcatgcagtcaataatacctccattaattgccgttattggtagcgatggttcaggcaagtcaacggtgtgtgaacatcttattaccgttgtcgaaaaatatggtgctgccgaaagggttcatttaggaaaacaggccggaaatgtcggtcgtgcagtgacaaaattaccgttgatgggaaaatccttacataaaacaattgaacgaaatcaggtaaaaacagcaaaaaaattgcctggaccagttccggcgctggtaattacagcgtttgtcgcccgtcgcttactgcgctttcgtcatatgcttgcctgtcgtcgtcgcgggttaattgttttaaccgaccgttatccgcaggaccagattcctggcgcttatgatggtacggtgtttccgcctaacgttgaaggtggtcgttttgtctcatggctggcaagtcaggaacgtaaagcatttcactggatggcgagccacaagcccgatctggtcatcaaacttaatgttgaccttgaagttgcctgcgcgcgtaaacccgaccataaacgggaatcgctggcgaggaagattgccataacgccacagttaacctttggtggtgcacaactggttgatatcgacgccaatcagccactggaaaaggtgctggttgatgcagaaaaagcgattacggattttatgaccgcgcgtggttatcactagtgaaaaatggaaatgcccgatcgccaggaccgggcattttcaggaaggttaaatcaactgcaatgctatccagtacaacccaccagaaagaaaaatcgccgccggtaaagtaaacacccacgccatcaggatgctggttaccgttttacgctgtaacccaccgccgtccaccaccatcgtccctgctactgcagacgagagtacgtgtgttgtggagacgggcatcccaatataactggcaaggccgatagacactgccgccgtcatttgtgccgccatgccttgcgcatacgtcatgccgcgcttaccaatcttctcaccgatggtcatcgctacacgacgccagccaatcatggtgccgatgccgagcgccagtgctaccgccatgatgatccataccggtgcgtactcaatggtgcttaacatatcgctgcgcagttttttcagcaggttctggtcttctttactgacgcctggcagtttcgccagcttcgcggaggtatcagagatgcacagcataatgcggcgcagctggctgcgctgactcacgcttaacggctcgtaactttccatattgcctggcagcatcgttttaacgcgcgcaatcgcatcaaaggtatttgccggatgacagtgaaactctgttacttgcgtgccatcagtcgatgtcgcaggcaatggaggttccatcgtaatcaacttctgcggcagttcaggatgctgttgcaggtagtgttcgaagttggtgacggcatcgcgggtacgggtaatttcatagccggacgcattcatattgacgacaaacccggcgggagcaatccccaccagcaccagcatcaccagaccaattcctttctgcccgtcgttcgcgccgtgcgaaaacgccacgcccgcagcggaaacaatgagggcaatacgcgtccagaatggcggcttacgtttgccttttttctttttgcgatcttcaggaatacgatgaatacggtcacgctttttcgtcccactccagaaacggcgtagcagaaaaattagcccccccgcaatcaccagccccacgatgggagagacaatgagtgaagagaaaatcttggtgacttcgcgcaggtttaacgcatccatcaccgacgagccggttaacagcgcgttggttaaaccaatgccgataatcgcaccaatcaaagtgtgcgaactggaggccggtaaaccaaagaaccacgttcccaggttccagataatcgccgccagcagcatggaaaagaccatcgccagaccgtgagttgaccccatattcagcaacaaatcggttggcaacatatggacgatggcataggcaacgctaagcccgccaagcaatacgccaaaaaagttaaaaaatgccgccatgaccacggcaagctgtggttgcatggcacgggtataaataacggttgccaccgcattcgccgtgtcatgaaaaccattgattgcttcatagaacaacacaaatgccagagcaagtaataacaaaagccccgtatatatatcaaggccaacaaataaatttagcatatattagattacgccattttgaatttacgaacggaggcattatcagtgactttcacggcgtgggcaaagtgaaatatcattttttaacgataaaaagcgtgttatttcttgtgtatcagacaataagccttcattcaaaacctttagaaataatcaaaacacaggtatttcacttgttaatatattcatatataaaatgaataaatattgaaatatataaatattgaatattttgattaatccccgtactgattattcttcataatcagtacggggttgctacaacatgtattactctttcaccacaattaacggttcaatatcactctcttttttgatgaccagtgattcatcaccgcgcaaacacgtcccaccgtagttgccgccaacggtgaaagtacatacctgaatgtatttaccgtccactttcggcaaacaccacagttgctggtaaatatttttctgttcggcaaatttaccactggtctgatcaagcacctcttcatgatggctgaccaggtcaatgttgctaccacagcgcccggcaatcggtttaacggcataaccggttttaaccagctcatcattcacggtgaagtcagtatccaacagataacgatggtgcgggaacagcgaccagaggatcggcagaatcgctttgttgccggggatcaccgtccacagcggctcaaagaccagcacttccgggcgcagcaatacgtcgataagacgcacttcattttgcggatgaccggtccgaatcggcactgcggcaaattcacggtcgctcacttcgcggatttgatcaaatgccgtttcccacgcccaggttttccatacgcagttaacctgtcgcccttctccatcaatcagttgcccggcagcatcccaacgcagttcctctaacccgcgtaaaatacgcgtttcaaagcctgcttgttgcagcgcctgctccataaactgcgcgtgatagttttcctcgatatctttgtcctgcatgatatggacaaacggacgtgcacgactgtgtttccacgcgccagccagttcgttaatcagtccttccgcaggattgaagccgttgcctttatagccctgctccgcccaacgttcgaggatcaagcccgcttcggtatgacaggaggcagaatcggcgttgtattcgtagactttcaggccacgttcatccatgcagaaatccatacgaccagtgatcatatgatgacggcgacgctgccaggagagacgcaaacgtggccagaggattttcggaatgtcaaacagcgccagcaggttgtcatctttcagcaccttgtcggtggcgtgaagatacatcaggtgcagctcgttggtggctttaatcagctcctgctcggcactctcggtaatggtgtagtaatgatacggatcctgattgatcacctggccgttggcctgtacataggcgttttgcagcggatctttttcatccagccatttaccgtcaaactggcctttgttttccagacgcgccccgctgattttcagcagttcgcctgcaatttccggctgtggcaagctgtattcggtatcttccgtctggatcatccagcccagaatagtggtgtcatcgaaggtgtctttcagggtatagccgccgttttcgaccaccatctccagctcgcgtgtccactgttgcccttgcggcaacggggtatgaatcacgttctgttccgcaatacggactttgttgccatgcaattgggtaatgatggcgacatggccagtgtctttaaattcaccgcctttatcccagataagaagcgcccccgctaccggtgcacgcggcgaaccgttaggaaatgcctgcaatggcaggatgttgtcattgaccacttcacgcaggaagcgcagtgagaaaatctcccatgccatacccacgtcagtgaagactacaccgtagttcagaaagagaaaacggcgagcaaattcaacgcattgccatttgtggcccatatattcatcgtcgatatagctacggaatacggcgtcatcttcgtattcctgcggatcgagagaactgtaatctgaagagtagattgctaccccacctggggcgtagcccaataatgtcccgaacggggcatcctggctggtcgttcctttgctcatcactttacctttaacaatacaacctaagcagttggcgtaattgttgtgctctgattacctgctcagcgacattaaccggacagaggtcagactaatcatacacctcatcgcagcggctggcgcaaagggttaaaaaattcacattctgtacagcaagtgacctgctacactgcttcaacactaccactcagaaggcaactcactatgacagacaatacttatcagcccgcgaaagtctggacgtgggataaatccgctggcggcgcgttcgccagtatcaatcgcccggtttctggtccgacgcatgaaaaaacgctgccggtgggcaaacatccattgcaactttattcgctgggaacgccgaacggtcagaaagtaacgattatgcttgaggagctgctggcactgggcgttactggtgcagagtacgacgcctggctgattcgcattggcgatggcgatcaattctccagcggctttgtcgaagtgaacccgaattcgaagatcccggcattgcgcgatcatacccataatccgccgatccgcgtgtttgagtcaggctcgattctgctttatctggcggagaaatttggctacttcttgccgcaggatctggcaaagcgtactgaaacgatgagctggctgttctggttacagggcgcggcaccgttcctcggcggtggttttggtcacttttaccattacgcgccggtgaaaattgagtacgccatcaaccgctttactatggaagccaagcgccttctcgacgtgctggataagcaactggcgcagcataagtttgttgcgggcgatgagtacaccattgcggatatggcgatttggccatggtttggcaatgtggtgttaggcggcgtatatgacgccgcagagtttcttgatgcgggcagttataagcatgtacaacgctgggcgaaagaagtgggcgaacgtccggcagtgaagcgtgggcgtattgttaaccgcatcaacggaccgctgaacgagcagttgcatgagcgccatgacgccagtgatttcgagacaaatacggaagataagcgtcaggggtaatggttagcgttcgtcgcagcaagccatccagaccaatgtaggccggataaggcgttcacgccgcatccggcaatcaggcacaatgcctgatgcgacgctgccgcgtcttatcaggcctacgaaagcatccggctttaatcatcacgcgctggtaatgtcgtaatccatttggcgcagtgcgtctaatgtggctttggcttcgtcttcatcgataatgctcatggcaaatccgacgtgtaccagtacccactggcccagcagatcggcagggttaccttcacaaatcagggcgatattcacgtcgcgcttgataccacatacttcaacctgcgcaagctggtgaatatcttcaccgacagccagcacctggcctggaacgccaatacacattgttaactccggttattcaacttcaatacttttgacgattagcgaatcgccggtatcgacacgcaaccgctcgccgtgacagatcggacactgcgcatcgtgctgatgaatctccaccacctggctgcaatcccaacaccaggcctgggcgggtttatagacgatatgtaaatcgcacccttgcgctaccgttccgtggcagacaatttcaaaactaaaacggacggcgctctcctcaacgcaggagagtgcaccaatttccagccacacggcggtgacgcgcttaacatcgtgctgctccgcctgccgttggataatttcaacggcgctctggcaaagcgacaactcatgcattttcgccactcctgcggccaaatagcagggcacgacgccctgcgtgtggtacatccggattggtgactggcagcgaaaggatcattcgggcgcagtcatccgtcagccgttggccctcttcaatcgacatgctgtgcgaaagcggcgacatcagcgagcaggagaggtattgcgaaacaccgtccagttcaccaacagtaaaggtcatagtgccatacggcagttgcagaccaattttttcactcactttgcgcagcggccagagttgatccgggccggggaagataactgcactcagcatccacggggtgatcacacaccccgtccactgaccttcgaacagcgtaaagtcagaaacatacaccggcattgaaggatgcagaaaagagagatcatgcatcgaacgccgggcaatttcttcaaaagctacctgtacttgcgccttcggggaggtctggaaacctgctatctcttcagtcatgagtcgcctcccgtgggatagcttccacgcctgattcgcgcagcgcagccagaacctgctcaagcgcaggttcaatcatcgcttcgaccgtcggtgtcaaaccgatgtgtggctccagtgattccgggatcacgccgaccagggtcagctttttcggaaactcgccggtgaagcgcagggccgacaatacgtcggccaggccaagctgatgcggagagattttgttggtaaacaacgccggaacttcttcatcccgcaggatcatcatcgttcccggtgcgttcttttttgacacaatggcatccgcaataatcagatgatcgcgatttgccatgtcaccaagcagctccattcccgccgtgccgccatcgaggatctcaacataatccggcagaatgtatcgttgctctaacgcttcaacaatccgcacaccgatggcttcatcggtcagcaaaatattgccgacccctaagactaaaatacgcattacagaaccttcactgaaaccacttcgttgccgtcggcatccactacgtgtaccgcacaggccatgcacgggtcgaaggagtgaatggtacgcaccacttccagcggtttattcggatcggcaaccggtgtacccaccagcgactgctcgtaaggaccgacgtcatcattgaagttacgcgggccagagttccaggttgatggaacaaccgcctggtagttactgataataccgtctttgatcaccatccagtgagagagcataccgcgcggtgcttcgaggaagcctacgcctttgaactcacccgttgccggaatgttcggcttcacaaaggtggtgtgatcgcctttgccgatattggtgatcagtgcactgtattgattttgcaggatatcctgcaattcacagcagtgaacggtacgaccaataatacggcccagcgtggagtgcagctgcgccacttccagcgtgttgccagtcagtttctgataaatcgcaacgatttcattcagtttgttctgggtagactcgcgtcctgccgccagtttcaccagcatattagccagcggacccacttctaccgttttgccgtagaaagtcggtgatttcacccaggaatatttaccgtcgtcagaccaaccatcataagccggaatggtggtaccttcccacggtgcctgcggcgcttcgtctttataccaggagtgcttcgcgctttcctgaatccctttgatcaggtattcatcggaatgagaagtgatcggacgatacgaggacagatccgcattctcaatgtagccgcccgggaacaggaagctgccatttttactgtcggtcgggaattccggcacgctcaggtagttcaccgcacctttaccgcgcgtcagccattccgggtagaacgcagcgataactgcagtatcaaccttgtaaacctgctcaacaaagtcgctcagcttgtcgatgaaggacttgatgtacatcaggcgctcaaggttcagcacacccagaccgtcgaggttgatcgggttcgcgacaccacctaccgccaggttctgaatatgcggcgttttaccgcccagcagcgccacaacgcggttagcgtcacgctggcactccagcgcctgcaggtagtgcgctaccgcaatcaggttcacttccggcggcagtttcattgccgggtgaccccagtagccattggcgaaaatacccaactgaccgctggcaaccagatctttgatcttgttctgaactttggtgaactcttccgggctgttcagatgccaggtcgaaacgcctttcagcatttcggaggctttggctggatcagcttgcagtgcagaagtgatgtccacccagtccagcgccgaaagctgatagaaatgaacaatatggtcatgcgtggtgtgcgcagccagaatgatgttacggatgtattgcgcgttaaccggaacgtcgatattcagcgcactttctgccgcacgaacggaagacagcgcgtgagtggtagtacatacgccacagatacgttgcacaatcatccatgcatcgcgcggatcgcggtttttcacgatctcttccatgccgcgccacatggtaccggaagcccatgctttcgaaacgacgccattttcgatttcgcaatcgatgcgtaaatgcccttcaatacgggttaccggatcaatagtaattctctggctcatgctttgctcgcctcatgacgattatgatcgttttgttttaaaggaggaagtatcggcagtagacgaatgagtacgatataagcgcaaatctcaatagccacaaaaccaatagaaatcaacagttcttcccaggtcgggaagtaggcgtaaccgccacccgggttgaatgccaccagcgaataggtcagacgccaggttgcacaacctaacagtgcactcagtgctgacaggaacagcatgcgggaatcattacgcaacttcgccacacgcagaacgaccagcgggaagagcatcagcaggacttcaatccagaacatcacggagtagaagtcaccggcaaacgctaacgacagcttgtcgcgatagataagctcgccaaagcgcagcacgatgaaaatcgccagcaacacactgatggtgttggtcagcttaacgaacagactcttttcatccggaccgttgccacgcagacccgcctgcaccaacgaaccttcaaagatgacaatcgagaagcccatgatgaacgccgtcagcagcgagaacagcggcaacatttcatagctttgccacagcggatgcaccttgtagcccgccgagatcatcagcgaccccattgaagactggtgcatagttggcagcagcgcaccaagcgcgatgatgaagaacatcaccttgttcagacgtttgagtgacaccttccagcccagacgttcaaacaatgccggagcaaactccagtgccatcacaccgatgtagatggtcatacagaccgccgtctcgaacagtaccgagttcacgttgaagtgacccggaatgtagaagtacggcaggttccagtagcgacccacgtcgatagtgatcgacaagccacccagtgaataaccaaacagactcgccaacagcgccggacgcaccagcggatggtattgcccacggttaaagacgtatactgcccacgccagcgcccagccgccacaggcaaagccggtaccgatcagcaggtcaaacgcgatccacacgccccacgggaagccgccgttcaggtcggagacagagcccagaccgaacaccagacgcttcacaatcaggagcatacagatgacgattaacggtccaaaaatcatgaccggtttactgatgattttgccgcccagcggttgtggatcatgactcatgatcgtctcctccgtcgtgatggtcgtttttagtgttgcgacgaaccagcacggttaagcccgccagcacagccagtggtagcatcatgcctttatacagggtgtgttggacatgttcggaacgcgcaccagtagaaagatcgtccagtttcggcaggtcgagattttcataaggcacacccgtcagtaccagaacctgagtaccgccgccctctttctcgccgtacagatgcggataatatttcggcaccgtatgcaggtaagtgtcgccagatttcagcgtctgacgcggatagtggtattcgctgcccggcttcagcgccagacgttttttcgcctccgccatcagctcttcacgcgtaccaaaaatcaccgcgcccgccgggcacacttctacacagccaggcagaccgcctttatcgagacgttccacacctttctggttgcacaactcgcacttatgcagcgcaccaaacgggttgttgtagtcgtacttcggcacgttgtatgggcaggcgaccatgcagtaacggcaaccggtgcacacatctttgtcgtaatggacaataccggttttcggatcttttttcagtgcagagaccggacacacagagacacagttcggatcgacgcagtgcatacactgtttcttaatgtacgcgtagccattctcctcctggtctttgttgacccctgtgctgctggtccacacctgaatgatgttattggtatacggcgacagtttgtcgttgttcgaccaggtctgttccccttgcgggttacgttcagggaagttgatatcctgacacttggtgacgcaagcctgacagcctacgcacaaggtcgagtcgtacaacatccccagcgatcccggaattggcgggcggttttcagcagccgcatgactgacagacggcagcgcgcccgtcagcaatgccccgcaggaggctgctttaataaaattacgtctgttcacggttattctccccgtgagtcagcgttatctttcttttgctgacgacccagttcacgcaccgccatcacgctgacaccggcaaccagcccaaccacaccgccgagcaaaccaatagcgcctgccgagacgttgccgccttctttagcgttaacgtccggtttctgtgaacgcggagtctggttttcgacgttggcaagctgatggatgcctttatggaagccgataccttcttcgttacagccatagcacgggtgaccaatcgctaccggccacacgccgccaacatcgcagaattgcagcgttgagcagttgccgtaagtttctggccctttacagccaaggtggtacaggcaccagccttcgcggtggccttcatcaccgaactctttggcaaaacgaccagcatcgaagtgcgggcgacgttcacagtgttcgtgaatcagacgaccataggcgaaagtcggacggtttttgtcatccagtctcggcggtttgccataagtgatgatgtgcgcaacggtcgccaggaagttgtgcgggttcggcgggcagccaggaatattgataacggttttgcccggtagaacttcttgcaggctgactgcgccagttgggttaactccagctgcggcaacaccgccccacgcagagcaggaacctatagcgataatggctgctgcgccttccgccgctttgcggatgtgatccacaatcggctcaccggcaaccatgcaataaataccgttatcttttaatgggatggaaccatccaccactaacacatactgccctttgtacttctcgagagcgttatgtttgttctcttcgacctgatgaccgaaggcggcggaaagcacttcgtgatactccagagagatagtctccagcacgaggttttctaccgttggatgcgttgcacgaagcagagattccgtacaaccggtgcactcctgcgcgccaatccagataactggcggacgctgcgggttagtaaccgattcggccatctctgcagcggctttgctacttaaccccatggtggcggctaatgctgcacaaagcttcatgaaatcacgacggttaatgccgtgagaatggatgagggtgttatctccagtcatttatagttattccgttgcgaagacctggcatatattttgcctcaatcgcaaaatcaataatgcgatcgatgcgccatttaccacacatttattatggttatcgatatcatgatactgcggcggggcactaaaacgaagggaagaagcattagtgtaattaattaaagcaagataatacgtatgtttgatcaattttctaggcgataaccggccataaaaaagcgcaacgtagaacaggaattattctcacgaaagaaatccattaccatctctttatccagtccataacggcgcgtcagaatacccgcttcccaggcgctaagctggcgatctccggtcttttcgtacatccggtgtgagtagcctaatacaaaaccgcgtttataatcggcacagaattttgtcacattaaccgcactgtcggcatgcgttgcttttaatcccgccattaagcctttaccaaaatggttattcatcgttcacctcattcgctatatattgtcatatatagcgatattttaggcaaagaacgacatttgcgcacgctattttttcatgcttgtttaagacgtaatcctgtaagagataaacccatcaggagagatatttatcgaaccatttcagcgtcctttgccaggcaagatcggcggcagatttgtcataacggggcgtggaatcattatggaatccgtgattaacccccggatatatatacgcctcatagaccttattattggctttcaacgccgcctcgtaagcgggccagccctcgttgattcggctatccagttcagcgtagtggagcagtaaaggcgcttcaatcttcgccacatcggcagtgggtgcctgacgcccataaaacggcaccgcgcaggccagttccggatacgcgactgctgccgcgttcgatacgcccccgccatagcaaaatccgctaatacccactttgcctgtcgcttgcggatagcgttgcataaactcaattgcggcaaagaaatcattcatcagtttggttggatcaacctgctgttgcagctcacgacctttatcatcatttcccggataacctccaacggaacttaagccgtcaggtgccagggtgatataccccgccttcgccactcgccgcgtcacatcttcgatatacggattcagccctcgattctcatgcaccactaccccggctggcgttttgccgctcatttttgcgggcttcaccagataaccccgtacctcgccgtgaccatttggcgagggatacgtgatgtactctgcaacaatttccgggtcggtaaactctacctgagtcgccagcgcataatttggcttgagcaaatcaaacagcgctaatgccgtcatcccgcccactgcatacttcgccgcaaagttgaggaactcacgtttcgagattttcccgtgagcgtaatagtcgtagtaatccagcaactcttgtgggaaatctttggcggttaaacgcggcatcgttgcactcctcaactggtgtttttttaagcaaagcataagcgcgtgtttttgcccagtttttcgtcactctgtgagccagactacgggatacgcgctggcgaatcgctaaactagaaacattgtttcgaaattgaacgatggaaaggagaggtcatggtctggttagcgaatcccgaacgttacgggcagatgcagtaccgctattgcggaaaaagtggtttacgcctgcccgcgttatcgctcggtttatggcacaatttcggtcacgttaacgcgctggaatcacagcgtgcgatcctgcgtaaagcgtttgatttaggcattacgcactttgatttagccaacaattacgggccgcctccaggaagcgcagaagagaactttggtcgcctgctgcgcgaggattttgccgcttatcgcgatgaactgattatctctaccaaagccggatacgatatgtggcccggcccatatggctctggcggctcacgtaaatacctgctcgccagcctcgaccaaagcctgaagcgtatggggcttgagtatgtcgatatcttttactctcatcgcgtcgatgaaaatacgccgatggaagaaaccgcctctgcgctggctcatgctgtacaaagcggtaaggcgctgtatgtcgggatctcctcttactcgccagagcggacgcaaaaaatggtcgagttgctgcgcgagtggaaaattccgctgttaattcatcaaccttcgtacaatttactgaaccgctgggtggataaaagcggcctgctggataccctgcaaaataacggcgtgggctgcattgcctttactccactggctcagggattgctgaccggaaaatatctcaacggtattccgcaagattcacggatgcatcgtgaagggaataaagttcgtggtctgacgccgaaaatgctcaccgaagccaacctcaacagcctgcgcttattgcatgaaatggcacagcagcgtggacaatcaatggcgcaaatggcgttaagctggttgctgaaagatgagcgagtgacgtcggtattgattggtgccagccgcgcggagcaacttgaggagaacgtgcaggcgctgaataatctgacatttagcaccgaggagctggcgcagattgatcagcatatcgccgatggagagctgaatctgtggcaggcgtcttccgataaatgacctgttaataacgggcgcgagaaccgcgcccgaatcagatcagtgattatgacgagtcagtcggtcaagatagcccatcacaaatgcagagagcacaaacgtcagatggataatgacgtaccacatcagtttgttatcagggacatttttcgcatccataaagacgcgcagtaagtgaatggaagaaattgccacaatcgacgctgctactttgtttttcagcgacgttgcgtccattttccccagccagttcagcttctctttgttctcagagatatcgagttgtgagacgaaattctcgtaaccggaaaacatcaccatcaccagcaaaccgccaaccagcgtcatatccaccagcgacagcaacacgaggatcaaatctgattccgccatcgagaagatattcggcagtacgtgaataatctcctggaagaacttcagcgccaaggcaactaacgccagcgaaaggccaaagtacacgggggcaagcagccagcgagaagcatacattgcattttcaagaaaacgttccatacattcctgtcgtgtagttaaaacgggcaacagtatatcgcaattaagtaaacagcacgcaacagcaaatcaacatatacgttaaacctttgtcgcataattctgagggttagggatcttcctggttcccttatcaacgcatcgagagcgtctacccttaaaggacgttgaacctgaagggagaaaaatgatgtctcatttaaaagacccgaccacgcagtattacactggtgaatatcccaaacagaaacaaccgacgccaggcatccaggcgaagatgacaccggtaccggattgcggcgagaaaacctatgttggtagcggtcgcctgaaagatcgtaaagcactggtgacagggggcgattccggaatcggtcgcgctgccgccattgcttacgcgcgtgaaggggctgacgtggcgatcagttatcttcccgtggaagaagaagacgctcaggatgtgaaaaagatcattgaagaatgcggacgcaaagacgttctgctgccaggcgatttaagcgatgagaaattcgcacgttcgctggttcacgaagcacacaaggcgttaggcgggctggatattatggcgctggtagccgggaaacaggttgccattcctgatattgcagacctcaccagcgaacagtttcaaaagacctttgccattaacgtttttgcgttgttctggctaacccaggaagcgatccccctgctaccgaaaggtgcaagtatcatcaccacttcctcaatccaggcataccagccaagcccgcatttactggactatgcggctacgaaggcggcaattctgaactacagccgtggcctggcaaaacaggtcgcggagaaaggtattcgggtgaatattgtcgcgccaggcccgatctggacagcactgcaaatttctggcggacaaacgcaggataagatcccgcagtttggtcagaaaacgccgatgaagcgtgcggggcaaccggcggagctggcccctgtatatgtttacctggcaagtcaggagtcgagctacgtcaccgcagaagtgcacggtgtctgcggcggcgagcatttaggttaaaaaaatgcccggttgtgaaaagcaaccgggcatcatttttatttcgctttcgcagtttcttcgccgaccagacctattttcaggtaacccgcctgatgcagcgtatccattaccttcatcaacgtctcgtaatcgacagttttatccgcacggaagaagatggtggtgtctttcttgccttcggttaacgcattcaacgccgtaatcattgtttcatcggtgaccggatcgttaccaataaacatcgagttgtctgctttcaccgacagataaaccggtttttccgggcgcggctgcggcgtgctggtagaagcaggcaaattcaccttcacatctaccgtcgctaacggtgccgccaccataaagataatcagcaaaaccaacatcacgtcgataaacggcgtcacgttgatatcatgcatttcgccgttatcgtcgaggttttcgttaagatgcatcgccatcggacattatcctgcacgtaatttttgtgcgacacgaaccggatgcgcagcggcgctggcttccagatccaggtcacggctttgcagcaacaatacctgcgctgcaacatcacccagcatcgctttaaagccgccaatctggcgtgcaaatacgttatagataacgaccgcaggaatcgctgccacgaggccgattgccgttgctaacagagcttctgcaatacccggcgcaacgactgccaggttagtggtctgcgtttgcgcgataccaataaagctgttcatgatgccccagaccgtaccaaacagaccaacgaacggcgaaatcgcgccgatggttgccagatagccgttaccacggcccatttgacgacctactgcggcgacccgacgctccagacggaagctggtacgttctttaataccttcgttatcgtcgctgccttctgacagttccagctcattctgcgcttcattgagcaaatgcaggctcaagcttttgctaccaaaatcagcggcgatatcgttggcctggtttaaggaacgcgcttcagccagcagttgctgctcgcgcttaagacgacgcttctgattgaagaactccacgctcttactgaagaagattgcccaggtgactacggaggccaaaataagcccaatcatcacgcacttaacgacaatatcggcgtgctgatacataccccagacggagaggtccgtctgcattaaattattacccactgtgtatctccaggacgcaagtcacaaaatctgtgcataataatatcaaaacgacgtcgaattgatagtcgttctcattactatttgcatactgccgtacctttgctttcttttccttgcgtttacgcagtaaaaaagtaaccagcacgccatttgcgaaaattttctgctttatgccaattcttcaggatgcgcccgcgaatattcatgctagtttagacatccagacgtataaaaacaggaatcccgacatggcggacaaaaagcttgatactcaactggtgaatgcaggacgcagcaaaaaatacacgctcggtgcggtaaatagcgtgattcagcgcgcgtcttcgctggtctttgacagtgtagaagccaaaaaacacgcgacacgtaatcgcgccaatggcgagttgttctatggacggcgtggaacgttaacccatttctccttacaacaagcgatgtgtgaactggaaggtggcgcaggctgtgtgctatttccctgcggggcggcagcggttgctaattccattcttgcttttgtcgaacagggcgatcatgtgttgatgaccaacaccgcctatgaaccgagtcaggatttctgtagcaaaatcctcagcaaactgggcgtaacgacatcgtggtttgatccgctgattggtgccgatatcgttaagcatctgcagccaaacactaaaatcgtgtttctggaatcgccaggttccatcaccatggaagtccacgatgttccggcgattgttgccgccgtacgcagtgtggtcccggatgccatcattatgatcgacaacacctgggcagccggtgtgctgtttaaggcgctggattttggcatcgatgtttctattcaggccgccaccaaatatctggttgggcattcagatgcgatgattggcactgcggtgtgcaatgcccgttgctgggagcagctgcgagagaatgcctatctgatgggccagatggtcgatgccgataccgcctatataaccagccgtggcctgcgcacattaggtgtgcgtttgcgccaacatcatgaaagcagtctgaaagtggctgaatggctggcagaacatccccaagtagcgcgagttaaccaccctgctctgcctggcagtaaaggccacgaattctggaaacgagactttacaggcagcagcgggctattttcctttgtgcttaagaaaaaactcaatgatgaagagctggcgaactatctggataacttcagtttattcagcatggcctactcgtggggcgggtatgaatcgttgatcctggcaaatcaaccagaacatatcgccgccattcgcccacaaggcaagatcgattttagcgggaccttgattcgcctgcatattggtctggaagatgtcgacgatctgattgccgatctggacgccggttttgcgcgaattgtataacattgccacttttggacaattttgcagacattttattgtgaaaagtcttaaattgttgcgtccgggatcaaggcgtcccggacgattcaggagtacaataggcagataaaggcttaaacgctgttccacaggaaagtccatggctgttattcaagatatcatcgctgcgctctggcaacacgactttgccgcgctggcggaccctcatattgttagcgttgtttactttgttatgtttgccacgctgtttttagaaaacggcttgctgcccgcctcatttttgccaggcgacagcttgttgatactggcaggcgcattgattgcccagggggttatggattttctgcctacgattgcgattctgaccgccgcagcaagtctgggctgctggctaagttatattcaggggcgctggttagggaataccaaaacggtgaaaggctggctggcacagcttcctgctaaatatcaccagcgcgccacctgcatgtttgaccgccacggtctgctggcgctgctggctggacgttttcttgcatttgtccgtacgctgctgccaaccatggcgggaatttccggtctgccaaaccgccgcttccagtttttcaactggttaagcggattgctgtgggtcagcgtggtaaccagtttcggctatgccttaagtatgattccgttcgttaaacgacatgaagatcaggtaatgacgttcctgatgatcctgccaattgccttgttaaccgctggcttgttgggcacgctgtttgtggtgattaaaaaaaaatactgtaacgcctgacgattttccccgttcccggttgctgtaccgggaacgtatttaattcccctgcatcgcccgcattcttgccgcatcttcccccggcgtcacaccgaagtaacgtttaaactcacggctaaattgcgatgcgctttcatagccgacgcgcatcgccgccgcgctggccttcatgccgtcgtggatgatcatcatccgcgccttatgcagacggtaattcttcaaatactgcaacggcgaggtgctggtgacagacttaaaattatggtggaacgccgatacgctcatgttggcttctgccgccagttgctcgacgctcaggttttcggtgtatttattctcaatccgtttcagcacgcgactaatcaggctgaagtgagtctggcggctgaccagtgccagtaacgcgccgccgcaaggtccggtcagcacgtagtacagaatttcgcggataatctgtttgccgagaatgcgcgcatccagcggtcgctccatcacatccagtaaccgctctgccgcgcataaaatctcttctgataacgtggcggagttaataccgctggctgccattgacggctgaaaatgttcatcttcgccaatgtccatcaacagttcctgtaactgcaaaatatcgacattgagacgcaaccctgccaacggcacctctgacgtggcataggtttcgcactcaaacggcaacggcaccgtcagcaggagatattcattagcgtcataacgaaacacgcgttcattgatataaccgattttatgtccggaaaatagaattatgatgccaggctcgtacatcaccggtgtgcgtgcgaaaggcgtctcgccatacaacaaacgcacatcgggcaacagctctgacaaactattttctttatttttcagtttattaactttatccgccagcaagcggcaaatctcttcacgtttcatatcgcgtaatttcttaggaataatgcggcaatttgattgtgcgcaattttgtagcatttctccagcactctggagaaataggcaagacattggcagaaatgagcattgagaggtacggcgctggcgaccacaatgaaaaacatcaggcagaccgatctctgccctcatattgacccagcaaagggagcaagtaatgaacaactttaatctgcacaccccaacccgcattctgtttggtaaaggcgcaatcgctggtttacgcgaacaaattcctcacgatgctcgcgtattgattacctacggcggcggcagcgtgaaaaaaaccggcgttctcgatcaagttctggatgccctgaaaggcatggacgtgctggaatttggcggtattgaaccaaacccggcttatgaaacgctgatgaacgccgtgaaactggttcgcgaacaaaaagtgacttttctgctggcggttggcggcggttctgtactggacggcaccaaatttatcgccgcagcggctaactatccggaaaatatcgatccgtggcacattctgcaaacgggcggcaaagagattaaaagcgccatcccgatgggctgtgtgctgacgctgccagcaaccggttcagaatccaacgcaggcgcggtgatctcccgtaaaaccacaggcgacaagcaggcgttccattctgcccatgttcagcccgtatttgccgtgctcgatccggtttatacctacaccctgccgtcgcgccaggtggctaacggcgtagtggacgcctttgtacacaccgtggaacagtatgttaccaaaccggttgatgccaaaattcaggaccgtttcgcagaaggcattttgctgacgctgatcgaagatggtccgaaagccctgaaagagccagaaaactacgatgtgcgcgccaacgtcatgtgggcggcgactcaggcgctgaacggtttgatcggcgctggcgtaccgcaggactgggcaacgcatatgctgggccacgaactgactgcgatgcacggtctggatcacgcgcaaacactggctatcgtcctgcctgcactgtggaatgaaaaacgcgataccaagcgcgctaagctgctgcaatatgctgaacgcgtctggaacatcactgaaggttcagacgatgagcgtattgacgccgcgattgccgcaacccgcaatttctttgagcaattaggcgtgccgacccacctctccgactacggtctggacggcagctccatcccggctttgctgaaaaaactggaagagcacggcatgacccaactgggcgaaaatcatgacattacgctggatgtcagccgccgtatatacgaagccgcccgctaagctttttacgcctcaaactttcgttttcgggcatttcgtccagacttaagttcacaacacctcaccggagcctgctccggtgagttcatataaaggaggaacgtatggctaatccaaccgttattaagctacaggatggcaatgtcatgccccagctgggactgggcgtctggcaagcaagtaatgaggaagtaatcaccgccattcaaaaagcgttagaagtgggttatcgctcgattgataccgccgcggcctacaaaaacgaagaaggtgtcggcaaagccctgaaaaatgcctcagtcaacagagaagaactgttcatcaccactaagctgtggaacgacgaccacaagcgcccccgcgaagccctgctcgacagcctgaaaaaactccagcttgattatatcgacctctatttaatgcactggcccgttcccgctatcgaccattatgtcgaagcatggaaaggcatgatcgaattgcaaaaagagggattaatcaaaagcatcggcgtgtgcaacttccagatccatcacctgcaacgcctgattgatgaaactggcgtgacgcctgtgataaaccagatcgaacttcacccgctgatgcaacaacgccagctacatgcctggaacgcgacacacaaaatccagaccgaatcctggagcccattagcgcaaggagggaaagacgttttcgatcagaaagtcattcgcgatctggcagataaatacggcaaaacacctgcgcaaattgttatccgctggcatctggatagcggcctggtggtgatcccaaaatcggtcacaccttcacgcattgtcgaaaactttgatgtctgggatttccgtctcgacaaagacgaacttggcgaaattgcaaaactcgatcagggcaagcgtctcggtcccgatcctgaccagttcggcggctaacgtgcaaattctcccggtggcggtaatgttccgctaccggacttttcagaaatcatttattcccctcgcgtcccgcccgttgctactcttccttgttcaggaatgccaaatataaggacatcatcatgcagagccggaagctcttaaaagaacaactcatctatatccgggataaacgcaacggagaggtgaaaaacagatgaaaataatacttctgtttttagcagccctggcaagttttaccgtacacgcacagcccccctcacagaccgtagaacaaacagtccggcatatttatcagaactataaatcagatgccactgccccttattttggtgaaaccggagagcgggcgataacatctgcgcgtattcaacaggcgcttaccctgaacgacaatcttacgctgccgggcaatattggctggctggattatgatccggtttgtgattgtcaggattttggcgatctggtgttagaaagcgtagcgataacccaaactgacgccgatcatgccgatgccattgtgcgctttcgtatctttcaagacgataaagaaaagacctcgcagacactgaaaatggtggcggaaaatggtcgttgggtcattgacgatattgtcagcaatcatggcagcgtcttacaagcggttaatagcgagaatgaaaaaacactggccgctatagcttcgttgcaaaaagaacagccggaagcctttgttgccgaactctttgaacatattgctgattatagctggccgtggacgtgggtggtttccgactcttaccgccaggcggtcaatgccttctataaaaccaccttcaagacggccaacaatcccgatgaagatatgccaatagaacggcaatttatttacgacaatccgatctgttttggcgaagagtcgttattttcacgcgttgatgaaattcgagtcctggagaaaaccaccgattccgcccgcattcatgttcgctttacgctgaccaatggcaacaacgaagcgcaagaactgattttacagcggcgcgaaggtaagtgggaaatcggtaatgactccaacttactgatagtgttttatgttcagataatgcccgatgaccttgtcatgcagctccaccgattttgagaacgacagtgacttccgtcccagccttgccagatgttgtctcagattcagattatgtcgctcaatgcgctgagtgtaacgcttgctgataacgtgcaactttcccttcaggcgtgattcatacagcggccagccatccgtcatccataccacgacctcaaaggccgacagcaggctcagaagacgctccagtgtggccagagtgcgttcaccgaagacgtgcgccacaacagtcctccgtatcctgtcatacgcgtaaaacagccagcgctgacgtgatttagcaccgacgtagccccactgttcgtccatttcagcgcagacaatcacatcactgcccggttgtatgcgcgaggttaccgactgcggcctgagttttttaagtgacgtaaaaccgtgttgaggccaacgcccataatgcgtgcactggcgcgacatccgacgccattcatggccatatcaatgattttctggtgcgtaccgggctgagaggcggtgtaagtgaactgtagttgccatgttttacggcaatgagagcagagatagcgctgatgtccggcagtgcttttgccgttacgcaccacgccttcagtagcggagcaggaaggacatctgatggaaatggaagccacgcaagcaccttaaaatcaccatcatacactaaatcagtaagttggcagcattaccgggaaatcgctgattttatccgcccgaacagcggcagcctacttaagcagattgaggcaaaaaccgccgccagattaaaacaatgagctgaattaaataacaattagccggaacaataaataaaagggaacactatatgaaaacgattttcaccgtgggagctgttgttctggcaacctgcttgctcagtggctgcgtcaatgagcaaaaggtcaatcagctggcgagcaatgtgcaaacattaaatgccaaaatcgcccggcttgagcaggaaatgaaagcattacgcccacaaatctatgctgccaaatccgaagctaacagagccaatacgcgtcttgatgcacaggactatttcgactgcctgcgctgcttgcgtatgtacgcagaatgataaaaaaatccccggcagcattctgttaccggggatattttttaacgtccaaccgccgctttagggcgtttcttcgcaccagcattctgcaggcgagattgcgtagacgacgctttttttgccgtagcaggcgtctgacgctgggtcgccatcggcgtatgtttagtcaacgccggacgggtattgcggttctggcggcgagcctcacgcatctcttcaatggttggcgcaggcactaagcaatcgcgacggctgccaatcagatgctttttacccattgcttccagcgcctggcggattaacggccagtttgccggatcgtggtaacgcaacaacgctttatgcaaacgacgctgtttgtcgcccttcggcacgaagacgtcttcactcttataaccaatcttcgccagcgggtttttgccggtgtaatacatggtggtcgagttagccagcggcgacggatagaagttctgcacctggtcgaggcggaagcgatgctttttcagccacagcgccagattcaccatatcttcatcacgcgtacccgggtgtgccgagatgaaatacgggatcagatactgttctttacctgcctgtttcgagtaagtatcgaacagctctttaaagcggtcatagctgcccatgcccggcttcatcatcttcgataacggtccttcttcggtatgttccggggcaatcttcagataaccgccgacgtgatgggtcgccagctctttgatatagcgcggatcttctacggcgatgtcataacgcacaccagaggcaatcaggatctttttaatgcctttcagatcgcgcgcacggcgatagaggttgatcgtcggttcgtggttagtgtccatatgcggacaaatatccggataaacgcacgacaaacgacggcaggtttgctcagcgcgtggcgatttgcaacgcaacatatacatgttggcagtaggcccaccgagatcggaaatcacgcccgtaaaacctggaacagtgtcgcggatcgcttcaatctcattaataatcgaatcttcggaacggctctgaataatgcgcccttcgtgctcggtaatagaacagaaagagcagccgccaaagcagccacgcataatgttgaccgagaaacgaatcatttcgtaagccggaattcgggcattaccgtaagccggatgcggcacgcgcttgtacggcagcgcaaagacgctatccatctcttcggtagaaagcggaatagcaggcgggttgatccatacatagcggtcgccatgtttttgcatcaatgcgcgggcgcagcctgggttagtttcgtggtgcagaatgcgcgaagcatgggcgtacagcactttatcgcccttcactttctcaaaagaaggcagcaacacgtaggttttttcccacggtttcgggcgtggtggctgcacggttacagctttcgcttcctgctttttcggggccaccggtttgttatccgcgcacggcaaatcttcgccatacggatgcgggatcgggtcgattttcccgggagtatcaagacgggtggaatccacgccactccagccaggcaacgcctcttttacgataatcgcggtattacgcacatcgcggatttcactaatcggctcgcccatcgccagacgatgtgccacttccaccagcggacgctcaccgttaccgaacatcagcatgtcagctttggaatccaccaacaccgaacggcgcacggtatccgaccagtaatcataatgcgcggtacggcgcaggctggcctcaataccgccgaggatcaccggcacatctttccacgcctctttacaacgctgggtataaaccagtgtggcgcgatccggacgcttacccgcgacgttatccggtgtgtaggcatcgtcatgacgtaaacggcgatcggcggtatagcggttgatcatcgagtccatattgccagctgtaacgccgaaaaacagattcggtttacccagacgcatgaaatcgtctttgctgctccagtctggctgggcgatgatccctacacgaaagccctgcgcttccagcatacgaccgcaaatcgccatcccgaagcttgggtgatcaacatatgcatcacctgttaccaaaatgatgtcgcagctatcccagccaagttgatccatctcttcacgtgacatcggcaaaaacggtgccggtccaaaacaggcggcccagtactgcggccaggagaacaggtcgcgatccggttggatcagggagatagagctcattttgcttccagaaatggtaaaaaaataatcaaaggccggggattatacgctgtatcacgcgcggaaatgaagtgatgttgatgaacggtggcgaaataccctggtgaggtttttcactgcccgacttgggcaagcacatttaaggctggcggtatcgtggcaactgccgctactatttatgccgatcagcaacgttcaaatcatattgcacgacgatcggctatccgaggacacccacagtaaggcaaggtatggaacaggttattacaaagcgccgctattacgatattggtctacagattgaagagctgctgtattcaggcgtattcaaagccggagaacgcttaccttcagaacgtgaactgagcgagcggtttaataccagccgaactaccattcgtgaagccattattatgctggaactgaaaggcgtattgaatgtgaagcaagggtcagggattttctttgtcgactccaccgataagctcaaccagaaatcattaatgccctattcagaaattggcccgtttgaactgttgcaggcgcgtcaggtgattgagagcaatattactggttttgcagccagccagattagctttaacgagttacaagagttaaagaaaatcattggattacaggaaaaagccatcgctgcggaaagtgataaatttgaagacctggatcaccgatttcatagcattattgccgaagcgacgcaaaatcgggtactcatcaaacaagccgctgaattatggcgggcagtgcgcacagaaaacccccgctggaagaaacttaactacaagtacctgcatgaaaagcatttgcgtctgcaatggctggaagatcaccgggctattttcctggctctgcaacagaaagattcagagctcgccagggaagcgtcctggagacatctggaaaacagcaaaaatgaactgatcaaaatcttcaaacaagacgcttccatcagcgattttgatgactttttcttcgctcgttaaccttcattagtccagagctgacgtgaaaaatgacgctggctctgcgttgcaccctccactggtatacgctcccttctcaattggtctaataaatcgattatcatcagatatcttagattagcggcaattatcccaaaaactgacctctaaaaaactttcctttcattttattcatataactcattgatacagatataaataacgccttgttgttctgtttcgtacttttgcctttctctgcaagcgtgatgcatctctctgtttttggtctagtgaattatgtaaattggtctatacacgccagctaccaggagtaagagcataatgtcagggaacgaaagtatcgatgccgcccactatgatcaggtaaccacctggcctcgggacgagttacaggcagatattgtccatattggttttggcgcttttcatcgcggacaccaggctgtctacacggatctcactaatcagctttcggacacccactgggggatctttgagatcaacctgtttggtgatgctcaactgatcgaaaacttaaatgcgcaaaatgggctgttttcggttgtggaaacatctgcatcgcaatctacctcacgccttgtgcgttcggtaactggcggtattcatacccccgtggatggcattgccgcagcaatccagaaattgactgaacctcaggtaaaaatcgtttcattaaccatcaccgagaaaggctattgtctcgattcgcaaacgcgatcgcttgatctcaccaatggattaatcaaacacgatctacaaaacccggatgcgcctcagtcggctattggcttgatcgtctgtgctttgcaacaacgtaaagcggcagggctcgccgcttttagcgtgctctcctgcgacaacttgccagacaatgggcatctgacgcgaaatgccgttctcggttttgcccgacaactggaccagcccctggctcagtggatcgaagaaaatgtctcatttccaggcacgatggtagatcgcattgttccggcaatgactgaatcgcaattcgccttactggaaacgaaaaccggttatgccgatccctgcgggatcgtctgcgaatcatttcgtcagtgggtgatcgaagataattttgtgcgcggacgaccggaatgggataaagccggcgcgatgtttgtcagcaatgttcagccttatgaagagatgaagttacgcatgttaaatggtagccattcatttctggcttataacggctcactggctggctatgaatttatctggcaatgcatggaagacgctgattttcgttccattacccgccaactgatgattaatgaacaagcccgaacacttaatccagacttaaatatcgacgcccaggaatacgccgacctgttaattgaacgctttagcaaccgtaatgttgcacaccgtaccgggcaaatcgctatggacggttcgcaaaagcttccccagcgagcgctgacgccctggctgaaattgcatcagcaaaaacaaaacaatgctgttctgtcactgctcgttgctggttggttgcattatgtcattgatgctgttgagaaaagccagtctgtcgctgatccaatgaatgaccaacttcaggcgctaataaaggaacaacaagacgcatggcaacaggcgctcgcattactgcaccttagcgccatatttggtgatttaagcaaccatcagccatttataaatgaaataaaaatcgcctttgcaaatataaaaaacaaaggcatcaaggccaccatcagccaattattatcggatgagcagaaatgaaaacattaatttgtcagcagcctggcgttatggaatatgtggaaaaggatattcccacaccagcagataatgaagtgctgttaaaaatcaaagctgtgggtatttgtggtactgatattcacgcttttgccggcagacagcctttttttagctacccacgtgtattaggtcatgaaatatgcgccgaagcggtttcgcgaggcagccagagccaaacagcacaatcaggccagcgctattccgtcatcccatgcattccgtgtggcgagtgcgcagcctgtcgggaagagaaaacgaactgctgcgaacgtgtttcgctgtatggcgtgcatcaggatgggggttttagtgagtaccttgcggtacgtgaagacaaccttgtgcctctccctgacgaggtcagcgacagtgccggagcattggttgaatgtttcgccattggtgcacatgccgttcgtcgggcagagatcaaggctgaacaaaacgtactggtgattggcgctgggccaatcggtctggctaccgcggccatcgccagggctaaaggggcgcatgttgttgttgctgatattgattgtcaacgtcgccagcacgttgtggatcatctggcgattaatgtcttcgacccaacacaggaaggttttattgccgcgcttagtgaagtgtttggcggcgaactggcttgcgtagtactggatgcgacgggaaataaagcttcaatgagtcaggatgtaaatcttattcgtcatggcggcaaaattgttttcatcggtttatacattggtgaacttgttattgacgatccgaccttccataaaaaagagacaactttactcagcagtcgcaatgccacacgggaagattttgcgttggtgattgaactgatgcgcagcaataaaattcacgaaaatttaatgaaaaaccaggagttcgatttctttagtgttggcgaagattaccaacgtaacgttgtagaaaataaaaatatggtcaagggtgtgatcactttttaagggaacaaatatgacaactgtttatgtcagtgaagaaaatttaaaatcactggtgcaccacaaattacataccgccgggctggatgccgataccgcacaacaggtgacagatgttttggtacatgccgatattaccggtgtgcattcacatggagttatgcgtgttgaacattattgcacacgccttgctgccggagggttaaataaagccccgcagtttagcattgagcaaatttcaccgtcagtggctattctcgactctgacgacggaatggggcattcggcattaattagcgccactgagcacgtcattaaactggcccagcaagagggcctcggttttgttagcgttaaaaacacgtctcactgtggtgcattatcttattttgcagagatgatcaccaacaaagggttggttgctattgtaatgacgcaaaccgatacctgcgtggctcctcatggcggcgccgagcgctttttgggtactaaccccatcgccttcggtttcccggtggaaaacagccatccgatgattgttgatatggcgaccagtgccacggctttcggcaaaatacttcatgcaaaggaaaccggaaaacatattggtgaagggctggcgatagataaagatggttatggcaccactgatccgcataagattgaaaacctgctacctttcggccaacacaaaggttcaggcattgcgctggctattgatgcactgactggcgtgctgatgaatgcgaattttggtaaccatattgttcgcatgtatggtgattatgacaagatgcgtaagctggcaagtttggttattgccatcgatccgaaaaagctcggcaatcctgtttttgcaaaaactatggcgcaaatggtcacggaactgcatgccgttaaaccggttcccggtgtcgaaaaagtgttagcgccgaacgatccgcaaatgcactacaaagaaaaatgccagcaggaaggtattccggttccggcaggaatattccattatctggcagagaattaatcactattttttattataacgatagaaaagcgctgtatttatcgtttctgttatattaaccaggagcaggatatgaaagcacttcgtcctctgacggcatcgcttatgctgttaaccagttgtttattaatatctaataccacactggcaaaaacaacattaaaactgagtcataatcaggataaaagccatgctgtccataaagcattaagctatttagcggataaaaccaaagagtattctaatggtgaattagttattcgcatttatccaaatgcgacattaggtaatgagcgtgaatcactggaattaatgaactccggtgcattacagatggttaaggttaatgccgcatcactagaatcatttgctccggattacagccttttcagtctgccgttcttattccgcgaccgtgatcactattatcgtgttctgcaaagtgatttaggtaaaaaaatacttaattcatcagaaagcaaaggttttgttggtattacgtactatgacggtggtgcgagaagtttttattccaataaaccgattacaaaacctgaagatttagcgggaatgaaaatcagggttcaacaaagccccagcgccattgcaatgatgaaagcactcggtggtgtcgctaccccgatggcgcaaggcgaactctacaccgcacttcagcaaggagtggttgatggcggagagaacaataccgttgtctatgccgatatgcgtcacgccgaagtcgcaaaagtctattcacgtgatgaacacaccatggtacctgatgtgttaattatcagcaccgacgtgttgaataaacttggtgataaagagcgcacggcattattaaaagcagccgatgagtcaatgatgcagatgaaggacgtcatttggcctgcggctgaaaaagaagcctacgacaaaatgaaagggatgaacgcaacagttgttgatgttgataaatccgctttcaaagaacgcgtcaaaccgttatacgatgaattcaaggcgaaagatgcacaatcagccaaaaaccttgagctagtagaaagtatgtaaccctaatgggcaggtaattcctgccttttcatggaagacttatgcgaacactcactcatattcttaataagatccttgccggatgttgctgcattattctcgccattatggtgttctgcgtaacctggcaagttattgcacgttttatttttaacgctcccagcactgtgcttgatgagttcacccagattttatttatgtggatgattttgcttggcggtgtatatactgcgggtttaaaaaaacatctggccattgatttgttggctcaaaaacttccggctgcatctgttctgacgcttgacagttttatccaaattattattacggtctttgcggttattttcatgatctatggcgggaatattgttgttgaaaaagcacaacatgttggacaaatctctccagtattaaaatggccaatggataaagtatattgggttatgcctgtcagtgggcttattctggtctggtattcagtaatgaatattattgacaactatcgtaaacggaattctcattaacgagggaaatatggaatttgaatatatctaccccgtcttaattttatttggcagttttgccgtcatgctggcaataggtgtgccaattacttttgcgattggtctttcttcgctgttatctattattactgccttgccacccgatgccgccatttctgttatttcacaaaaaatgactgtagggctggatggctttacgctattagccattcccttcttcgtgttagccggaaacattatgaataccggtggtatagccagacgactggttaacctggcgcaagcattagttgggcgtcttcctggctcactggctcattgtaatatcctcgcgaatacactgtttggtgcgatttcaggttcagccgttgcgtcagccgcagcggtaggtgggattatgtcaccactgcaagatgatccggcgttttcagcagcggttaatattgcctctgcccccattggcctgatgatcccaccgagcaatgtgttgattgtttattccctcgccagtggcgggacttctgtcgctgcgttgttcttagctggatatctgccgggcatcctcaccgctgttgccttaatgtttgtagctgcactttatgcacgacgtcaccattacccagtggccgaacgcatcaattaccgtcagtttttacaggtattccgcgaatcaattcctagcctgatgcttatttttatcattattggcggtattatcgcaggggtatttacgcccacagaagcatcagcaatagcggtaatttatagtttagccctggcgatgatttaccgggaaatcactcttaagaagctcaatgatattctgttagattcggtagtaaccagttcaattgttctgttactggtaggctgttcaatgggaatgtcatgggccatgacgaatgctgatgttcctgagttgatcaacgaactgattacccgcgtttcggataacaaatgggtcattctgtttattatcaatatcattctgttgatcgtcggtacctttatggatatcacgccggcgatcctgatatttacacctattttcctgccgatcgcccagcatctggggattgatccgattcacttcggcataattatggttttcaacttaaccattggcctttgcacaccacctgtcggcaccattctgtttgtggggtgcagcattggtaaggtcagtatcgacagggcaataaaaccattactgccgatgtttctggcattgtttgtagtaatggcaattatttgttatttcccgcagcttagtctgatgctgccaggattattttcgacctgatacacaatgaagactgcatactgagtaattttcaatgccccaccactctgtggggcattgaattggtccattacggtaccggattgaccaacagttgcccaatcgagccacggtccgccatttccagcgtctgactgttgaagtagaacgggaagtgcgcccaggaaggctgaccgaaataaacaagcagctccacttgtccgtcaacccaaacggtatctttccagcctctgtcttccgggaacggcatcgcgccattcacgttacggatctggaacatcacgccttcaatatggaacgcttgcggctcgtccgcgcgcaccgtccagcgttcccacgttccttgctgcgcagtaacatcaatacggttgacgtcccacaactgcccattaatccccgggtcatcacccagactgatatcacgacttcgaatcggcgaaccggccatgatttcagttggcagcaagcgcatcggaagactgtctgtgaccagcggcagaaggccggttgggcgcagcgttagcaccagcgtagaaaccagaatgctggatggctcaaagaagccacgaatacgatcaacaatgctcgccgcttcgccacaggtaatcgacacttcatcaccgttgctcatatccaccagaatctcacgacgctcgcccggtgccagcgaaagttgcttcaccgatacaggagcgggcaggaatccctgatcgccagaaatcacatgtaacgggcgaccatcgctcatctgtagttgatagcgacgagagttcgacgcgttcaacagacgcaagcgcacccagccacgcgagacttcaacgtacgggctttgtacaccgttaaccagtagcgtatcgccaacaaagccgccgcttcccggttcgttatattctggcgtaccaaagttatccagccgtttatcctgaataatgacaggaaaatcatccacaccataatggttggggataggcagcgatttactgacttcatcttccaccagccacattccggcaaggccgttataaacctgctgagccgtgcggttgggagtattggcgtgataccacagagtagctgcgttctggcgaatgggcagtacgggtgcccagtcagcatttggcgacatcatccgtgccggaccgcccatcagcgggccaggtacctgtagcccggccaccgtcattgagacattttctgtcaggcggttgctgtaaataagcttaacatcgtcgcccttccagacgcggatagtcggccccaggtaacgaccattgattccccaaaccgacgcgcgtgtccctggcgtaaatgaccagtgcgcacgttgtacagtcataaacagcggttgcccacggcgagattcaagcagcggcggaacgggtagcggttgctgttgcccggctgcgctggccttcaggggaacagcgcctgcacaaagtgcaatccccgatgcctgaatgaactgacgccgactgagtgacatatttgctccatgtaaaactggctaaagtaataccgtgcaggaaagtgttccccgcaaaaatacagattgccgacttaaacttttccggcggcttcgcgttctgcgacttctttatcgagctcggcgattttttgttccattatcgaacgacaatgggcagccaactcgcgaacctgatctttgccatactgactgacgtcaattggcggcagcatttcgacaatcaccagaccgttgtgtagccgattaagattaatcttattcgaagttgtagagacgcacacgggtataatcgggacgcccgccgcaattgccgcgtgaaatgccccggtcttgaacggcagcaggccgcgaccacggctgcgggttccttccgggaacatccagatggaaatacggcgttttttgaagtgattcactacttccgcaatagtgccgtgagctttagtgcgattgtttctgtcgatcaataagttgccggttaaccagtacaactgcccgaagaaggggatccacagcaagctctttttacctaccgtcactgtcggcggctgcacaatgttcgatgccgtcaccatgtcataattgttctggtggttagcaatatagatagcattgccgtagctttcagcgtctgcaggtttgcggcactccactttcaggccgaaaagcggcgcaagacggccaaacatatgcccaaaggtggccacatgtttcgggttacgcgggctgaaaaggcagtaaatggagccgaatacacagactaagatgctgtaaatcacggtaataataagacgaaagatatatagcataacaccctctgaaggtctgagagactggcattgtacgtcacctgaaaatcaggttagggcattgttaaaagccgctctctggaaaagcgtattgttaatcgcaacgcatgaataaacaacggtttcaagggaatttttatcgtttccggggattgaatacgctgccggatgacgacttaacgtttcatccggcgttccttgcaagcgggaggaaacagcgccctccccggcatattactcttcgctatcaccgctgctggcacggcgaggagagtcgatctcaacacgatcgatacgctgcaaaccgcgcatcaacgtaccgcggcgtccacgttcgccagcgactttctgtagctcttccggacgcagtttaattttgcgtttcccaacatgaatggtcagcgtgctttgcggcggcagaacgtacagttgcgccaggccatcctcgccacgcgcggcttctgccgatggaatgttgataatcttgttgcctttgcccttcgacagctgcggcagatcgcttaccgggaacatcaacatacggcctgcctgagtgattgccagcagcatatcggaagcatcttcaatcaccaccggcggcataacatgggcattttccggtaaggtgatcaaagctttacctgcacggttacgcgccaccagatcgttaaaggtgcagacgaaaccgtaacccgcatcggaagccatcagcagtttctgatcgtcgctttccatcagcatatggtcaacggtcgctccaggcggcaacgttaatttgccggtgagcggctcgccctgaccacgcgccgacggcagcgtaatcgggtcgatggcatagctacgaccggtggaatcaacaaacactaccggttggttgctcttacctttcaccgccgctttgaagctatcgcccgctttataattcaggcccggcgcgtcgatatcatggcctttagcgctgcgtacccagcccatctgcgacagcacaatggtgacaggttcagacggcagcatgtcgtgctcgctcatcgctttcgcttcttcgcgttcctgcaacggcgaacgacgttcgtcaccgtaggcttgcgcgtctgcctgcagttctttcttcagcaggttattcattttacgctcggaagccaaaatgccctgcaactggtcgcgctctttttccagctcactctgctcaccgcgaatcttcatctcttccagtttggcaagatgacgcagtttcagttcgaggatcgcttccgcctgggtttccgtaaggccaaaccgcgacatcagcgccggtttcggttcatcttcattacgaatgatctcaatcacttcgtcgatattgagaaacgccaccagcaaaccttcgaggatatgcaggcgcttgaggactttctccagacgatagttcagtcggcggcgcacggtatcgcggcggaacaccagccattcggagaggatttccagcaggtttttcaccgccggacgaccatccagaccgatcatattgaggttaatgcgatagctcttttccagatcggtggtagcaaagaggtggttcatcacctgatccatatccacgcggttggaacgcggcacaatcaccagacgggtcgggttctcgtggtcagattcatcgcgcagatcgtcaaccatcggcagctttttgttgcgcatttgcgcagcaatttgctccagtacgcgcgcacctgaaacctgatgcggcaatgcgctgataaccaccgcgccatcttctttcttccacaccgcgcgcatacgcactgaaccacgtccgttctcgtagattttacgaatctcggcgcgcgaagtgataatttccgcttcagtcggataatccggcccctgcacgatatccagcagctgatcgagagtggttttcggctggtcgattaatgcgattgccgcctgagccacttcacgcaggttatgcggtggaatatcggtcgccatgccgacggcaataccggtggtgccgttaagcaaaatgtttggcagacgggcaggcagcattttcggctcctgcaaagtgccgtcgaagtttggcacccagtcagccgtcccctgccccagctcgctcaatagcagctcggaatatttcgacaaccgggattcggtgtaacgcattgccgcgaacgatttcggatcgtccggcgcaccccagttcccctgaccatcaaccagcggataacggtaagagaacggctgcgccatcaggaccatcgcttcataacaggcactatcgccgtgcggatggtatttacccagtacgtcaccgacggtacgggccgattttttaaatttggcgctggcattcaggcccagctcagacatcgcatacacaatgcggcgctgaacaggtttcagaccatcaccaataaacggcaacgcacggtccatgatcacgtacatggagtagtttaagtaggcgttttccgtaaattcatgtagcgcaaggcgctctgccatatcgctcattaattctgattcctcaacttattcgccagccttcaaaggggcaatattgccggagatactacattatctgccgcgtcgagtcacaggagatcagcgtgaatagcgccgccggacgtgctccgacggcgataaaggcatcaatgtgccttgatatacaactctttgctgtagacataatcctggggattatgcagcggaaaaccgccaacgtagggtttaaatagtttgattaacggctgatagtagataggaatcagcggtgcctgctggttgatgatcacttctgcctgctgatacaacgcattacgctttgttgcatcagtgatctgcgtggcctggtttagtaaggcgtcatactgcgcatttttccagtgaccgacgttttcttcactatcgcttttgagcgtgttcaggaagctggaggcatcattgtacgtcgcatcccacgactgccgagacagcataaaatcaccggctcgtcgggcatcaagataggttttccactccattgtgcgcagcgtcacctgtgcacccagccattttttccattcggaagacaacgctatcgcggtcttttcatgcagatcgtacttgttgtagaacagctcaaagcgtagcggatgagaggcgtcgtatcccgcctgtttcagcaagacttttgccatcgcgacacgctcactcattggcttttgcagttcatcgaacgtcgtcgcgctaaagccttttacctctggcggcgtcagcgtggttgcgggcgttctcaaccccagtaccttttgcgcaataagctgtcgatcaaccgtaagatatagcgcccgacgcacccgcacatcgttaaatggcggtttctcaaggttaaagttgtaatattcgctgttcagacgcgggataattcgtagctcgccaggcagtgatttttcaatggcgggaatttgctgcgccggaacccaggtgagatcgacctctcccgcgcgatagcggttatagccggtgaccgaattatccagcgccagatactcaacctgttgcaatactgtatgttgcgcatcgcggtactttggatttttgcgtgcagtaatcttttcgttaactacccatttatcaagcacaaaggcaccgttgtaaaccatgttctctggcttactccagctatcgccatgtttagcgatgacatgatgaggaaccgggaacagcgtcggccaggcgagcatcgtcgtgaaccaaggaactggctgctcaagcgtaacttcaagagtacgatcatccgtcgctttgacacccagcgatgtaacatctgctttacccgcaacaatagccgcggcattgttaatgtgcgcctgtgccagatagccagcaaaagggcttgccgttttcgggtcaaccgcgcgctgccagccgaggacaaaatcctctgccgtcagaggctgaccgtctgaccactgcaaaccgctacgcagatggaaaatatagcgcttgccgccgtcaagtatctcccagcgttcagcctgagcgggctgcacctggccttcaccgtccatccataccagaccttcaaacagatccagcacaatctgcgcggcagtattctcctctaccttttgcgggtcgagcgtgcctgggtcgctatgattgttgtaacgaaagacttgttgcggggcgagcggtgtgttggcgggaacgtcagcagcgtagagaggagccgcacttaccaggctgaccagccataataaatttcgcgtatacatggtattccttaccggagaaattataagcccgacaacaatacgcctgtggcattgtttgctcaaacttatcgcgagtgatttggctcacactccggtaaagattccccatcacgccaacggcacataaatatccgtttccagtcgccgctctgtcatcccttcggcaagattgatgtagtgaaacaggatcggggctttgcgcattttttcgccgcttgcaggtagccagtggcgaatgatgccccatatcgtgtgtgaaatatcgtccagctcgccaacatggcgggcaacagcataacgcccaccggtaagttcgccattactcacgccataacgattatcggggatcgattcgctaacgctgccgcagatatcaaagcgaaacgcttccggtgcggtggtggcagggtcgtcccaggcgacgccaaaagtctggctttggttaacaggagaaagccccgtctctttacgccacatgataaatttcgccacgctgtagttgagcaactcagggctacagcggtgcggcaacatcgccacagggattgatgggaaatcgataatatttacatccagtgtcaggtttgtcattttgcctccctgcgaaattattcccgggaacgcgtcccgggagcggtaacaattacggatttactttgcggatctgtttgacgtcaatttcaacagagttccagtctttatcgacttcaccctgaatctcaaccgtatctttcggcgtcaccgtcacgccgttccagcgtttatggtcgatatcaacattgatagtaccgctggcatctttgaacacgtagagatcgtcagagatgcgttcaacgatattgccgcgtagggttacccaggtgtcgtcacgcagggattttgcgctttctacagtcgttacgctgccgttcggcccctggaatcctccggcctgactttgcgttgccgatgggccagaaaaacctccctgctctgctgccataaccggtgcactgcacagggccattactgcgattactgctgcgaattttttcatgtttattactccctttaatgtctgtttccgagcatttaacaagatagtccttaacaacttcttaagggaaaaaaataaaatttaatgctgtacagagcgcgttacaacacggtttactggcagcaaatacggttatcgcagggatgaaaaaatgcgaattttactgatagaagatgacatgctgattggcgacggcatcaaaacgggccttagtaaaatgggttttagcgtcgactggtttacacaaggtcgtcagggaaaagaggcgctatatagcgcaccttatgatgcggtgatcctggatttaaccttaccgggcatggatggtcgcgatattttgcgcgaatggcgagaaaaaggtcagcgtgagccggtactgatcctgaccgcgcgcgatgcgctggcggaacgtgtagaagggctgcgtctgggagctgacgattatctgtgtaaaccttttgcgttgatagaagtcgccgccaggctggaagctctgatgcgccgaaccaacggccaggccagcaacgagctgcgccacggcaacgtcatgctcgaccccggcaaacgtatcgccacgctggctggcgaacccttaacgctgaaaccaaaagaatttgccctgctggaattactgatgcgtaacgctggtcgggtactgccgcgcaaactgattgaagagaaactgtatacctgggacgaagaggtcaccagtaatgccgttgaagtgcatgtgcatcatctgcgacgcaaactcggcagtgattttattcgtaccgttcatggtattggctacacattaggtgagaaatgaaatttacccaacgtcttagtctgcgagtcaggctgacgctaatctttttaattctggcctcggtgacctggctgctttccagctttgtcgcctggaaacaaacaacggataacgtcgatgagttgttcgacacccaactgatgctgtttgccaaacggttaagtacgctcgatctcaacgaaatcaacgcggcggatcgcatggcacagacgccaaataaattaaaacacggtcatgttgatgacgatgcgctgacctttgccatctttacccacgacggcagaatggtccttaacgatggcgataacggagaagatattccttatagctatcagcgggaaggttttgctgacgggcaactggtcggtgaagacgatccctggcgttttgtctggatgacctcacctgatggcaaatatcgcatcgttgttggtcaggaatgggaataccgtgaagacatggcgctggcgattgttgccggacaattgatcccgtggctggtcgcactgccgattatgttaatcatcatgatggtactcctgggtcgtgaactcgcgccgctgaacaaactggcgctggcactacgtatgcgtgacccagactcggaaaaaccactaaacgcgacgggcgtacccagcgaagtgcgcccactggttgagtcgctaaatcaactgttcgcccgcacacatacgatgatggttcgtgaacgacgctttacctccgacgcagctcacgaacttcgtagcccgttaacggcgctgaaagtgcaaaccgaagttgctcagctctctgacgatgatccgcaggcgcggaaaaaagcgctgctccaattacattccgggatcgatcgcgctactcgtctggttgatcaactgctcacgctgtcgcggctggactcactggataaccttcaggacatcgcggagatcccgcttgaagatctcctgcaatcgtcggtgatggatatttaccacacggcgcagcaggcgaaaattgacgtgcgactgacactcaaagccaacggcatcaaacgcaccggacaaccgctattgctaagtttgttggtgcgaaatttgctggataacgccgtgcgctacagtccacaaggtagcgtggtagacgtcacgctgaatgccgataatttcatcgtgagggataacggccccggtgtgacgccagaggcactggcgcgaattggcgaacgcttctatcgcccacccggacaaaccgctaccggcagtggacttgggctatcgattgtccagcgaatcgccaaattgcatggcatgaatgttgattttgggaatgcggaacaaggtggatttgaggcgaaggtaagctggtaacttctctgtctatgagagccgttaaaacgactctcatagactttactaatagcaaaatataaaccgtccccaaaaaagccaccaaccacaacccagacaaataacgagcgagaatacatatagccaaaactcgaacatttcccgcataaagagttttcttaagataagaataataagtggtgtcagaagaaaaaatgctgcaatcattgcttgcaatatacgatcttcgcctgaaacagaaggtatactgcaaatattgtctcccgactcaagcatccagtcatacttattgaaagcaaaaaagaatctattaaccaataagtaagcattatatataatagtgcttcaaatattgatagtagttgtttttttaacatatctgattactcattaatcaatttttggatatgttctctaatctctaacaacctcataccataagagatgaatttataatcatctgtatcacgcgcaggcaaattattaattaaacaaataaaaaaaaccaaatctcgttcaacaccacgattatatctaataccagccataatatactgctcattcgtcatatacagtgttgccgaagagggataatcaaaaagaacaagatctcttaaataagtagcagcaatttgaaaggtaaaatcatcctccattaggcatgtcgctaactctaactgatttctggtagttaattctgaagggtctagacctagagtaatcgctgcggttcgtatttgtatacccattgagccaaatgatgttttattttcaggcatatctaacaatccgatcattctttttgtttcatatatctgaaacttataattttcaggcatacctcctgactcaatccaggccacgccgcccagtaactctggacgaattccagcggcgtatgcatgtttaattattttgtctctattatattgtacatatgcatctttataagcatttaaataatatactcctgaacggcgacgcgaatcattttttcctaacttccagagtaaaacgtccatttcatcccatttacggaacttcgcttgtggaattgtacaatatctattttttatagtgagatcgcttttcatatttaaaaaatcctttcttcccaacaactatatgattccgtactcgcgatatggtgcttccatgttatatttttataattaagaacaatgacctcttccggctgattacccgcatgtgtaattgagtgtggataacatgtcagaatattcgataaatgtgctccttgcaattcaattgtgtaaaacctttcaatacaaccgccagaattaattctataaaaattaaatacagctgataactcttcattttcagaaagagcggcatttaataaaggggaggatttatctattggcttgtaaaattttatggggtgatgcactacattatactctcgacttaaagaatggtcgaactgtaaaacaaaaatttcatccacatgatttatttgatatttattaccaatagatgcatacgaaccacaaccctcagagatcaaaccttgtattttccctttaattgataagtatatcatatttgacatatatattctccataatcattttttccgaaaaactcctgtatcatttgcataatacatctctcctgtgggagcttatgggaagttgatttaagtattgtcattttcagaaaatatttatcccgcatcggtgaatcagagaaagatcagacttttgctaaattcgcaaaagactttgcacattttgctaatttcaccgtaccgctctgtgacgtactatagtcggcaaacgtctcaccttgaggttaaaaaatgagcaacatcctgattatcaacggcgcgaaaaaattcgcccactccaatggtcaactgaacgacaccctgaccgaagtcgcggatggcacactgcgcgacctcgggcatgatgtccgcatcgttcgcgccgacagcgactacgatgtcaaagcggaagtacaaaactttctctgggctgatgtggtgatctggcagatgcctagctggtggatgggcgcgccgtggacagtgaaaaaatatattgatgatgtattcaccgaaggtcacgggactctgtatgccagcgatggtcgtacccgcaaagatccatcaaaaaaatacggttccggcggcctggtacagggcaaaaaatatatgctttctctgacctggaacgcaccaatggaagccttcaccgaaaaagatcagttcttctacggcgttggggttgacggtgtgtacctgccgttccataaagcaaaccagttccttggcatggaaccgctgccgacatttatcgctaatgacgtgataaaaatgcctgatgttccccgctatactgaagaatatcgcaagcatcttgtggaaatttttggttaactagagctctggctttagaaggagttaaccatgattacagtaatcgcagaaatccgtactcgtcctggtcaacatcaccgtcaggcagtgttggatcagtttgctaaaatcgttccaaccgtactgaaagaagaaggttgccacggctatgcgccaatggtggattgcgctgctggcgtgagtttccagtctatggcaccggattctatcgtgatgattgagcagtgggaaagcatcgcgcatcttgaagcgcatctgcaaaccccgcacatgaaagcatatagcgaagccgtaaaaggtgacgtgctggagatgaatattcgtatcctgcagccggggctttgacatttctaaaaagaggccggtgctgctaccggtctcagcccagattagccattctttcttcccgttttcagtcctcgatggaaatcgttaattcgcttaatggttttaaccgcacgctgcggcactgcggaagctaccgaccagacaatcatttccagacacaacaataccgtaccatgtagcggcgttttccctttttcatccccgcgcggaacatgaatcacgatactggcgtctttgctaaaacgtgaatccagcgcgtttgtcagcaaaataacagggatccctagccgcctcgcctcacgaagcgttgtcagcccttcccggtgcgctgatttttgcgccatcatgatcagaacatcgccacgttgaagcgcgatcagttgctcggcaaggccaatacccgtacggtttagtgccgtggcaggcaaacctatgcggttgaatagtcgtgcggtatagtccgccagaatacccgaagcgccaatgccaaaaattgcgacttgccgtgcctgcaccaacaacgctacagcttgcgcaagcgcgtggcggttttcaggctctgacaggacattacaggtatacaaatgcccttcaagaacaaagtcgattgcggtgttaacatcgctcgtcaagttactcaccgtcgtagacatcttttcgctggaactaagggctggaccaagccactgttccagagtgcgtttcagatcacgcagcccggcaaaccccagggcctgtatagccctgataactgtggcatcggaagtgttcaacgtggccgcaatttccatcgccgtttgctcgagtaccacttcacgatgctcattaatgtagctggcgacagctcttaacccaggcgttaactgactcgcgcgagtgtgaaaacgctcaccaaaaatatcaacccgcgctttatctttctggatcatttagcctccggtagaggtcgccctgcaatttgtgattgtatctgcgcagccatcagccccagagatgcaaaggagttagaaattgcctcttcacgagaaatcagcacataacgcccggaacgacaggcagtcagaaactgacaccatcccggcatgactttttccattgctgccagctcatcctgaggtttaccaccggtgtcaccgcgccaggttgcaaaaacaaaatcggcatccagttcaggtaaacgctccgcgctcacatccattcgcccaccttcaggaatgctctcaatcagcggcggaaaacgaaaaccagcatcgcgtaatacccgccccagcgaatgatagctatgcatcacattaatttttccctggtttgcctgaatcaccgataccgttattttttggctgtccagcgtcgccttcagcgcattgatttgtgcctgatagcggcgttcaagtatcgccagctgcgactgcgttcctgtaagttctgccagcttgcgatagatttctggcgcaccccctttgagatgatcaatgctcaccgtgggcgcaattttttcaagttgttcaatgggcgtattacgggtcggttctgtgatgatcaggtcaggctttgccgccacaatcgcttcaatatcaatatcagcggtaccaataaaggcgatcgatgaattatcaaagtcgacacctgtcaataacgcgccagatcgaatgaaatggctaccgtcaggccgagttcgcccgtggctggcgacaggaggtacaccgagctcaatcagaggaatagtgatatcaagatcgtgtaaagagacaattctctttggatgagcaggaacagtgactttgcgccctaaatcatcagtaaatacctgaacaggttctgttgcacgggaaaaaaatgacaacagtatcagcagagaaaaaaataaacgcatataactcccgttaaaaactgttcctgcgctgccagagcagtagcaaaaaaaatggtccaccaatcagtgagataatgattccggcaggcagttgcaaaggcaaaaaagccaaacgaccaatgctatccgccagaataactaacaacgcccccgataccgcgctccccagcagtaatgtcgtctgcccgccacgtagaataaaacgtgatatatggggtgctatcaatccgacaaaaccgatgttaccaacacacgaaacgcagacggctgtcaggattatgggtgcggcgacacgtaacaacgccagacgagaactattcacccctaacccggttgcaacctgatgaccaagcagagcgatatccgcagtcctggcggtgaacagcaataaaagagcggctggcaacatccaacaggctgaaataccgactaacatccagttagctgcatgcaggcttcccgataaccacatcaatgcagtttgtacatctcgaacatctgcagtggtcataaatacaccgataccggcggcgaaaaaccaggaaacaccaataccaatcagaacaaatcgcgggcgggaaatatcgcgcgcacaaaaaatcacgattaaagccaccaacaggccaccagcaagaccagccactggacgccagaacattcccagcattggaaactggaaaatcagccacagcacagccacgctacatccttctttgacgccgattaacccaggatcggcaaggccgttacgtgcaatggattgcattgcggcccctgccatacctaacatggccccgcatagcaatgccatgatgactctcggcaagcgaatatcctgcacaatataacgtgcgtctgtgcttacgttttctggagagaacaatgctcgtcctacttccgatgccgggacggagaaagagccatgcatcagaccgaatatcagtattccaaccgcaaacagaaacaacccaccaagcaacaccagatttttagggcgtaccagtgtcgaaaacttaccaacacgtagtggtcgtagcccgacgttcattatccgactcatttgaacatcctcgtcgccataatgacaaaaacgggcgcaccaactaacgccgtcatgacaccggtcgctaactcatggggcgtgaaaagcgtccgggcaataatatctgccagtaataacaaaagtgcgccgacacaagctgaaagagggagcagaacgcgcagatccgctgataccagacgccggacaatctgcggtaccaacaggccgacaaaaccaatggggccagcaatcgatacggctgcgccacagagcaacgcgatcgcaagcagggtaaatgttcgcgtgcggagtacagagacgcccagcccctgcgccatgcgatcgcccagtgccaacatgttaagggagggtgcaaggtaaagggctaacacaaatccccccagagaaaaccaggcggacgtacccagcgtcgcccaatcctgccccgctaaatcacctgctagccatgtccgcatcgccagcagtgtttgttcgtcaagaatcaggattgcagccgttattgaggacacgaacgccgatagcgccacgccgcataaagtaactttcattggcgttacccctgaacgccctgcggaggaaagcagcaatatcaacaggaacaataacgcgccccccgtagatgccagcagtgggcgtccaaccggaaaggccagtccaagcgcactggcggcaacgacagcaagagcggctccggcatttaagcctaaaatatgtggctcccccaatgggttacgaatgacagcctgcaacaaagcactaacaacaccaagagaagcaccggtaagcaatgctgccgctaaacgcggcaaacggagtcttacaattacgttgtgatcgaagttttgcggatcaaaatgaagaaatgcctgcaacaccgtttgtggtgcaataaatcgggcaccaatccctggatataccacgcatcccaccagcagtaaggcgaggaaaattacagtaaccagccctgtgcgcatcatactttttctacaccacgaaacggcatgaagaacggctttcccgtcagaggatttattgatgtgtgaacatcaacgtcaaagacagcttttaccagttcaggcgtgcaatgctccccctcattcaacacacgcaccactttcccctagcgtaaaaatatcaacgtatcgccataattgacggcaaaattcagatcatgcaacaccacgacgactgtacgcccgtgatgacgcgttaaatcatgtaataactcaagaatttcaacctgataacgtaaatcaagccaggttgtgggttcatccagcaggatataaggcgtcttttgcgccaacaccatcgcaatccagcaacgctggcgctgcccaccagagagtttttcaacaggtaaatgtgcaaactcctgcgtaccggttaatttcagggcctcttccaccgcctgctcatcggcgtcgctccattgacgtatgaaattttgccagggaaaacgcccacgcgacaccagttcataaacggttaagccctccggcaataatggcgactgcggcaagatcccaagtctacgggataacgctttcgttggttgctcgtgaatcgctttgccatcaagcaatatcgaaccgcccatgggttgcaagatacgtgcaatggtgctgagcaacgtcgactttccacagccgtttgccccaaccagaacggtcattttttctgtgggaacggagaaagaaacaccatcaacaatgatcttcttgtgatacccggcagaaacattgtcgaggatcagcccctgcccttttgcgttatgtgccacgtgtacgccaacttaatcaaagacaaacaaaaataaaactcattctcctttgagagtttgacgccacaaaatgtagtagtcaagcagttaaaagccacacaaaaacaaggtaaataacaggtaaaatatttttatacataaaaataaaaacattaaatatcaacaaattaaaagcaatcaaattgtataaacttttcataaaaacacatgtagcaattttttgttatttctcatttactactacattactgcgtgattgaatgattctcaattacatatccgatggcgaaataacaaacggatagtgcttagtgagcaataagaaacaattttcactcgcgacaatccgcgagtttttgggataacagactaaatggctatgttcacaccttcattctcaggactcaaaggtcgggcgctcttttcactgctttttgcggcaccgatgattcatgcaacagactctgtaacgaccaaagatggcgaaacaatcactgttacagcagatgcaaataccgcaactgaggcaaccgatggttatcaacctctgagcacctccacggcgacattaaccgatatgccgatgctggatatcccgcaagtggtcaatacggttagcgatcaggttctggaaaaccagaatgcgacaatgctggatgaggcgctttataacgtcagtaacgtggtacagaccaatacattaggcgggactcaggatgcttttgtacgccgtgggtttggcgcaaaccgggatggctccatcatgaccaacggtctgcgaaccgtacttcctcgtagtttcaacgccgcaacagagcgtgtggaagtgctaaaaggcccggcctccacgctatatggcattctcgatcctggcggactgattaacgtcgtgaccaagcgcccggaaaaaacattccatggttcggtttcagccacctcctccagttttggtggcggcactgggcaacttgatatcacaggtcccattgaaggcactcagctggcgtatcgccttaccggggaagtgcaggatgaagattactggcgaaacttcggtaaagagcgcagtacatttattgccccgtcactcacctggtttggtgataatgcaacagtaaccatgctctattcccatcgggactataaaactccgttcgatcgtggaacgattttcgaccttacgacgaaacagcccgtaaacgttgatcgaaaaatacgttttgacgaaccgtttaatattacagatggtcagtccgatctggcgcaactcaacgcagaatatcatctcaatagccagtggacagcgcgctttgattacagctacagccaggataaatacagcgataatcaggcgcgtgttaccgcgtatgatgcaacgacaggaacactgacacggcgtgttgatgcaactcagggatctacccagcgtatgcatgctactcgtgcggatctgcaagggaatgttgatattgccggattctataatgagattctgggtggggtgtcatatgaatattatgatcttctgcgtacagatatgattcgctgtaaaaaagctaaagatttcaatatatacaaccctgtttatggtaataccagcaaatgtacaacggtttcggcgtcggacagtgatcagacgatcaaacaggagagctactcagcgtatgcacaggacgcactctatctgaccgataactggattgccgtcgccgggatccgctatcagtattacacgcagtatgcgggtaaaggccgtccttttaatgtcaatactgacagccgcgatgaacaatggactcccaaactggggttggtctacaaactgacgccatcggtatccttatttgccaattattcgcaaacatttatgccgcagtcgtcaattgccagctacattggcgatcttccaccagaatcatctaatgcttacgaagtcggggcaaaattcgagctattcgatggtatcaccgcagatattgcgctgtttgatatccataaacgtaatgtgttgtataccgaaagtattggtgatgaaaccatcgccaaaacggcaggccgtgttcgttcaagaggggtagaagtcgaccttgcgggagcattaactgaaaacattaatatcattgccagctacggctataccgatgctaaggttctggaggatcctgattatgcagggaaaccattgccgaatgttcctcgtcataccggttcgctattcctgacctatgatattcataacatgccaggcaataatacgctgacatttggcggtggtggacatggtgtaagccgtcgttcggcaaccaatggggctgactattatctgccaggctattttgttgccgatgccttcgccgcatacaaaatgaaattgcagtatccggtcacactgcaattaaacgtcaaaaacctgtttgataaaacgtattacacctcttccatcgccacaaataatctgggcaaccagattggcgatccgcgtgaagtgcaattcacggtgaaaatggaattttgatcaaaaaagcccggtatacacttgtataccgggctatgttttattcttctggcgggaggattatcagacctcaatctctgccatgtcgcctttctcttgcaaccagttgcggcgatcttccgagcgtttcttcgccagcagcatatccatcatcgcgtcagtacgctgatcgtcttcatcatcgatagtcaactgcaccagacggcgagtgttcggatcaagcgtggtttcgcgcaattgcatcgggttcatttccccgagacctttaaaacgctggacgtttggcttgcctttcttgcgttttaattgctcaagtacgccctctttctcttcttccgtcagcgcgtaataaacctctttcccgaggtcaatacggtagagcggtggcagtgcaacgtaaacgtgaccgtgtttcaccaatgcgcggaagtgttttacaaacaaagcgcagagcagcgtggcaatgtgcagaccatcggagtcagcatccgccaggatacagatcttgccgtaacgaagctggctcaaatcgtcgctgtcaggatcgataccgatagctaccgaaatatcgtgcacttcctgcgaagccagcacttcgtcggaagagacttcccaggtgttaaggatcttacctttcagtggcatgatcgcctgatattcgcgatcgcgcgcctgcttggcagatccgcctgcggagtcaccttccacaaggaatagttcggtacggttaagatcctgcgcggtacagtcagccaatttaccaggcagcgccgggccgctggttagctttttacgcaccacttttttagccgcacgcatacgacgctgggcgctggaaatcgccatctctgccaacagctccgccgcctgaacgttctggttcagccacaggatgaaggcatctttcaccacgcccgaaacgaatgccgcacactgacgcgaagagagacgttctttggtctgcccggcaaactgcggatcctgcatttttactgacagcacataggcgcagcgatcccagatatcttccgccgacagctttacaccacgcggcagaatgttgcggtattcacagaactcacgcattgcgtccagcaggccctgacgcaggccattaacatgggtaccgccctgcatcgttgggatcaggttgacgtagctttcggtcagcagttcaccgccttccggcagccacagtagcgcccagtccaccgcttcagtatcgccagcgaaattaccgataaacggtttttctggcagcgtcggtaaaccgtttaccgcttccgccaggtaatcattcagaccgtcctgatagcaccagcgctgttcggtgttgttgatctcatctttaaaagtgatctcaacgcccgggcacagtaccgctttggctttcagcacatgcgtcaggcgtgaaacagaaaaacgcgggctgtcaaagaaggtttcatccggccagaagtgcacgctggtaccggtattgcgtttaccgcaagtgccgacaacctgtaaatcttgcaccttttcgccattttcaaaggcgatgttatagatctgaccatcgcggcgtacgttaacttctacgcgcttcgacagggcgttaactaccgaaatccccacgccatgcaggccgccagagaactggtaatttttgttagagaatttaccgcccgcgtgcagacggcaaagaatcagttcaaccgccggtaccccctcttccgggtgaatatctaccggcatcccgcgcccatcgtcaatcacttctaacgactggtcggcatgtaagattacatccacgcgttttgcgtggcccgccagtgcttcatcgacactgttatcaataacttcttgccccaaatggttagggcgagtggtatcggtatacatccccggacggcggcgaaccggctcaagcccggtgagtacctcaatggcatcagcgttataagtttgcgtcatggtttaagttagcaattcgagttgatcgtcagagatggtgcagaccaagaaaatcgacgatcgggttgaaataatcttcgaagcccgtgaatgcgtggttgccgccttctatgacagtctggcggcaggaagcgtagtacgccaccgcctggcggtaatccagcacttcatctcccgtctgttgcagcagccagatcaaatccggcgcttccagcgggtcaatctgcatgactttgagatcgtaaatatggcgtgactctagcacatattgctgcccggtgtaggggttctcgttctgaccgagatagtccgtcagcagttcaaacggacgcaccgccgggttgaccaccactgcgggcagcataaaacattgcgacaaccaggtggcgtaatatccccccagtgacgaaccgacaatacccagcgaatcgccgccatgttccaggacaatagattccagcagttctgccgcgtcagaaggatacgggggcaactgcggaatgatcatctcaacgtcagggtgatgttccgccagccagttttttaacaagctcgcttttgcagagcgcggcgagctgttgaaaccgtgtaaataaagaagcgtagacatcagtagccttctgaagcggtatcaggttggaagcgtgcgtccgccaggcgatgcacctcggtggtcagcgtgccatcagcatgtaactcgagagtacgccagccgggcgcgatggtgtccagcgtaaagttagaacagtgcggcttaaactgcacacaggtcgacggcgttgccagcaagcggcgaccgttccagtcgagatccagctcctgatgaatatgaccgcacagcaagtatttgacgtgcggaaacttcgccagcacggtatccagttcgcccgcgttacgcaggctgtgttgatcaagccaactacaacccgcaggtagcggatgatgatgcagcagcaacgtatggcgttctggcgcatcggccagtttacgttccagccactcaagctgaaactcgctcagctcaccgtgcggcacgccaaacacctggctatccagcaacaggatttgccattgctcaccaataaacacgcgcttcgccggggagatacccgcatcctgtaacgcgctgtacatcgcgggctggaaatcgtggttgcccggcagccagacgcagggcgcacgaaaacttgcgatgccttcagcgaaatgctgataggccgcagaggattgatcctgcgctaaatcacctgtcgcgacaatcaggtcgaattcgtgctggtgtggccgaatcgcctccagcaccgcctggtagctttcccaggtgtttacccctaacagggcttcgtgcttttgtgcaaacaggtgagtgtcggtaatttgtaaaatcctgactctggcctcaccagccagaggaagggttaacaggctttccaaatggtgtccttaggtttcacgacgctaataaaccggaatcgccatcgctccatgtgctaaacagtatcgcaaccagtccgctaaaaactgattaatttgatgcttttcgtcgcgttgatgcaactttttattaggataatcataccgcgctttgaagcgaaaaatctgctggcttgaacacacttcagccaccatcgcgtcatgatacagacgcaccgtcattgacggaaggctccagtaactgatcgcgggcgcagtctgttctattgtcaccagggtagtgtatcgggtcgattccacaatcgtcagccgatattgtgcgtttgccacctgatagcttacagtttcgccgggtgcgtcattgcgcggtaacaaacggcgcaattgtgaaaagttcatctcgcacaggcgcatcatttcaggaaagtcaggtgtgtaacgcttcatttatgcccactcattttttaacgcttgatgatgcagctgcagccattgcaaagcgatgaccgacgctgcgttgtcgattttcccctcttctacccactggtatgcctgttcccggcttaccacatgaacgcgaatatcttcgttttcatcagccagaccgtgaataccgcttgcggtcgtggcgtccacttcgcccaccataattgacgaacgctcactggtgccccccgggcttgccaggaaacttaacaccggtttggtccgtttgactatcagtcccgcctcttcaatcgcttcgcgacgggcaacatcttccacactttcaccctcttcaatcatcccggcaaccatctccagtagccagggggtttcgctggtgtcgtacgcggcaatccgaatctgctcaatcagcacaacttcatcacgcactgggtcaaagggtagcaagactgcggcgtgaccgcgctcaaaaatttcccgccgtacctcatgactcatttgcccgttgaatagacgatgacgaaatctataaagatctaatgaaaaaaagccgcgataaagtgtttctcgtgcaataatttctacatcgtttttgccaaatgtaacgggcaggttgtctggcttaagcattgttaatgtcctggcactaatagtgaattaaatgtgaatttcagcgacgtttgactgccgtttgagcagtcatgtgttaaattgaggcacattaacgccctatggcacgtaacgccaaccttttgcggtagcggcttctgctagaatccgcaataattttacagtttgatcgcgctaaatactgcttcaccacaaggaatgcaaatgaagaaattgctccccattcttatcggcctgagcctctctgggttcagttcgttgagccaggccgagaacctgatgcaagtttatcagcaagcacgccttagtaacccggaattgcgtaagtctgccgccgatcgtgatgctgcctttgaaaaaattaatgaagcgcgcagtccattactgccacagctaggtttaggtgcagattacacctatagcaacggctaccgcgacgcgaacggcatcaactctaacgcgaccagtgcgtccctgcagttaactcaatccatttttgatatgtcgaaatggcgtgcgttaacgctgcaggaaaaagcagctgggattcaggacgtcacgtatcagaccgatcaacaaaccttgatcctcaacaccgcgaccgcttatttcaacgtgttgaatgctattgacgttctttcctatacacaggcgcaaaaagaagcgatctaccgtcaattagatcaaaccacccaacgttttaacgtgggcctggtagcgatcaccgacgtgcagaacgcccgcgcacagtacgataccgtgctggcgaacgaagtgaccgcacgtaataaccttgataacgcggtagagcagctgcgccagatcaccggtaactactatccggaactggcggcgctgaatgtcgaaaactttaaaaccgacaaaccacagccggttaacacgctgctgaaagaagccgaaaaacgtaacctgtcgttgttacaggcgcgcttgagccaggacctggcgcgcgagcaaattcgccaggcgcaggatggtcacttaccgactctggatttaacggcttctaccgggatttctgacacctcttatagcggttcgaaaacccgtggtgccgctggtacccagtatgacgatagcaatatgggccagaacaaagttggcctgagcttctcgctgccgatttatcagggcggaatggttaactcgcaggtgaaacaggcccagtacaactttgttggtgccagcgagcaactggaaagcgcgcatcgtagcgtcgtgcaaaccgtacgttcctccttcaacaacattaatgcttctatcagtagcattaacgcctacaaacaagccgtagtttccgctcaaagctcattagacgcgatggaagcgggttactcggttggtacgcgtaccattgttgatgtgttggatgcgaccaccacgctgtacaacgctaagcaagagctggcaaatgcgcgttataactacctgattaaccagttgaatattaagtcagctctgggtacgttgaacgagcaggatctgctggcactgaacaatgcgctgagcaaaccggtttccactaatccggaaaacgttgccccgcaaacgccggaacagaatgctattgctgatggttatgcgcctgatagcccggcacccgtcgttcagcaaacatccgcacgcactgccaccagtaacggtcataaccctttccgtaactgacgacgacgacggggcttcggccccgtctgaacgtaaggcaacgtaaagatacgggttatctgccgcattcttcccccttctcgcttcaatttcgaccagccatcctctattctgatgggtatttaccactggtcccggaagacaaaaatgaaacggacaaaatccatacgccacgcatcgttccgcaaaaactggagcgcacgccatctgacaccagtcgctctcgcggttgccactgtttttatgctggctggctgtgaaaagagtgatgaaacagtgtctctctatcaaaatgctgacgactgttcagctgcaaacccaggcaaaagcgccgaatgtaccaccgcgtacaacaatgcgctgaaagaagccgaacgtactgcgccgaaatacgccacccgtgaagactgtgttgctgaatttggtgaaggtcagtgccagcaggcaccagcccaggctggcatggcaccagaaaaccaggcgcaggcccagcaatccagcgggagtttctggatgccgctgatggccggttacatgatgggacgtctgatgggcggcggcgcgggatttgcacagcagccgctgttctcctcgaaaaacccggccagcccggcttacggtaaatataccgacgcgaccggtaaaaactatggcgcagcccagccaggccgcaccatgaccgtaccgaagacggcaatggcaccaaaaccggcgaccactactactgttacccgtggcggttttggtgaatctgttgccaaacaaagcactatgcagcgtagcgcaaccggcacctcttctcgttcaatgggtggctgataccgatggaaagagtcagtattaccgagcgcccggactggcgcgaaaaagcccacgaatacggtttcaattttcacaccatgtacggcgagccgtactggtgtgaagatgcttactacaagttgaccctcgcccaggttgaaaagctggaagaagtcaccgccgaactgcaccagatgtgcctgaaagtggtggaaaaagtgatcgccagcgatgagctgatgaccaaattccgcattccaaaacacacctggagttttgtgcgccagtcatggctgacgcaccagccatcgctttattcgcgtcttgatctggcgtgggatggcactggcgaacctaaacttctggaaaataacgccgatacgccaacgtcactatacgaggcggcgttctttcagtggatctggctggaagatcagcttaacgccggtaacttgccggagggcagcgaccagtttaacagtttgcaagaaaagctgatcgatcgcttcgttgagctgcgtgaacagtatggcttccagttgctgcatctcacctgctgtcgcgacacggtggaagatcgcggaaccattcagtatttgcaggactgcgcgacggaagctgaaatcgctaccgagttcctctacatcgacgatatcgggttaggtgaaaaaggtcagttcacggatttacaggatcaggtgatttccaacctgttcaagctgtatccgtgggaatttatgttgcgtgagatgttctccaccaagctggaggatgcaggcgtacgctggctggaaccggcgtggaagagcattatctccaacaaagcgcttctaccgctactgtgggagatgttcccgaatcacccgaacctgctgcccgcttattttgcggaagatgatcatccgcaaatggaaaaatatgtggttaaaccgatcttctcccgtgaaggcgcaaacgtgtcgatcattgagaacggcaaaaccattgaagcagcggaaggtccgtatggcgaagaagggatgattgttcagcaattccacccgttaccgaaattcggcgacagctatatgctgattggtagctggctggtgaacgatcaacctgccggaattggcattcgtgaagaccgtgcattgatcacccaggatatgtctcggttttatccgcatatttttgttgagtaatacagcttaatattgccccgataagcggggcaatctcttataatccaccattcataactcccatcaatatataaacacatacatatccaacctttatttaacattaatactcaatttaatgttaaatcgtcatatgcaagcgatattgtaattaaagtaagtgaatacatcacaacataactatttgatattatttaaatactttacttttatctcaccagatttaaatttaataattaaaaaacaatgttgcagggatcacactacacagtattgaacattgtgattgatatattgcccccctactatccattaaacataaatatttgtttcaccgaataacaacatatttaaaagaaacacaaaagcattctcactctttattgaattaatatttatattcacgtaacgaatttattagcaccctctcaacagtcgatattcatcattattatatatttgcgttatataaggagatatatccatgtttgataaatatagaaaaacactcgtagccggaactgtggcgataaccctgggtttgtcagcatcgggggtgatggctgcgggttttaaaccagcgccacctgccgggcaactgggtgcggtcattgtcgatccctacggcaatgcaccactgaccgctttggttgacttagatagccatgttatttctgacgtcaaagttaccgtccatgggaagggcgaaaaaggcgtagaaatcagctatcccgtgggtcaggaatcactaaaaacttacgatggtgtaccgatttttggtctttatcagaaatttgctaacaaagtgaccgttgagtggaaagaaaacggcaaggtcatgaaagatgattatgtggtgcacacttcggccatcgtcaataattacatggataaccgctctatctccgatttacaacagaccaaagttattaaagtcgcaccgggttttgaagatcgcctctatctggttaatacccacacctttaccgcccaaggttccgatctccactggcatggtgagaaagataaaaatgccggtatccttgatgcgggtccggcaaccggcgcactcccttttgatatcgcgccctttactttcatcgtcgataccgaaggtgaataccgctggtggctggatcaagacactttctacgatggtcgtgaccgcgatatcaacaagcgtggttatctgatgggtatccgcgaaacgccacgcggcacctttaccgctgtacaaggtcagcactggtacgagttcgacatgatggggcaggtgctcgaagatcacaaactaccgcgcggatttgctgacgccactcatgagtccattgagacgccaaatggcacggtactgttgcgcgtaggtaagagtaactatcgtcgcgatgacggcgtacacgtcaccaccattcgtgaccatatcctcgaagtcgataaatctggtcgcgttgtcgatgtatgggatctgaccaagatcctcgatccgaaacgcgatgcactgctcggcgcgctggatgcaggtgcagtttgcgttaacgttgaccttgcccatgcaggacaacaggcaaaactggaaccagatacaccgttcggcgacgcgctgggtgtagggccaggccgcaactgggcgcacgtgaactctatcgcctatgacgcaaaagatgactctatcatcctctcctctcgccaccagggtgttgtgaaaattggtcgtgataagcaagtgaaatggatccttgcgccctctaaaggttgggaaaaaccgctggccagcaagctgctgaaaccggttgatgctaacggtaagccaattacctgtaacgaaaatggcctgtgcgaaaactcagacttcgactttacctacacccagcataccgcctggatttccagcaaaggaacgctcaccatttttgataatggcgatgggcgtcatctggaacaacctgccttaccaaccatgaaatactcccgctttgtggaatataagattgatgagaagaaaggcaccgttcagcaagtgtgggaatacggtaaagaacgtggctacgatttctatagcccgattacctccatcattgaatatcaagccgaccgtaacaccatgtttggcttcggtggttctattcatttgttcgatgtcgggcagccaaccgtcggtaagttgaacgaaatcgattacaaaaccaaagaagtgaaagtggaaatcgacgtgctgtcagataaacccaatcagactcactaccgtgcgctgttagtccgtccacaacagatgttcaaataattaagaagggaataaaaatgtcgaaattagggatctcatcactatttaaaaccatactgcttaccgcagctctggcggtttcatttaccgcttctgcatttaccgaaggcacggattacatggttctggaaaaacctattccgaatgccgacaaaacgctgattaaggtatttagctacgcctgcccgttctgttacaagtacgacaaagcggttaccggtccggtatcggaaaaagtgaaagatatcgttgctttcacgccgttccatctggaaaccaaaggtgaatacggcaaacaagcaagcgaagtctttgcggtcttgatcaataaagataaagcagcaggcatttccttatttgatgctaactctcagtttaagaaagccaagtttgcctactacgcggcttatcacgacaaaaaagaacgctggtctgacggtaaagatccggctgcttttatcaaaaccggtctggatgccgcaggtatgagtcaggcggattttgaagcggcactgaaagaaccagcagttcaagaaacactggaaaaatggaaagcctcttatgatgtcgccaaaatccagggggttccagcctatgtcgttaatggtaagtacttgatctacaccaagagcatcaaatccatcgacgcgatggcagaccttatccgtgagttagcaagcaaataacagggaaacaggctatgggtattaagggaatgtggaaagatcttcgcacatcaccagttgacacactggtcagatggcaggagcaacgcttgttgtggttgttaatggccgttgcgatgggcgcgttaattatcctggcgcactctttcttccagatctatctctacatggcaccctgtgagcaatgtgtatacattcgctacgccatgtttgtgatggttattggaggattggttgcagcgatcaacccaaagaacatcatcctaaagctaattggctgcgtgatggcattttacggcagcattttgggactgaagttttcgctcaaactgaacgatatccaccatgcagtacataatccggatcccgattcactgtttggcgtacagggttgctctaccgatcccacttttccctttaacctgccgctggcacagtgggcaccaaattggttcaagcctaccggggattgtggctatgacgcaccaatcgttcctgatggcgtcacactgagcagcacgcaacagtggtttgtggaaatgtatcagcaatctgaaggctggtatctgctaccaccatggcattttatgaatatggctcaggcttgtatgctggcttttggtatgtgtctggtgctgctggtcattatgagtggcgcatgggcgcttaaaatcatcagaggctaactcagcaacacccgaagccagtcgttctggcttcgggttcttttattaacctatctgcaccgacagcatacttaaactgcccatttctataccatcgaccggaatggtaattggctcctgcccatcccacgcacctaagacatacaacaacggcagatagtgctctggcgttgggttcgataacgcgccaccttcatggtcgagataattcaccagaggatgttgttccactggcccttgccacgtcagattcgctttcacatactcattaaacgacgccgcccacggatacggtgaactatcaccgtgccacttcactgtacgcaggttatgcaccacgttgccactggcgaccaacattatcccttcatcacgcagcgccgcgagtttgcgccccatttcgaaatgccaggcggcaggtttgctactgtcgatactcaactgcaccatcgggatatcggcgtcagggtacatcttaatcagtacgccccacgagccgtggtcgaagccccaggcttctttatccagcgtcacagggaccggcgctaacagctcaaccagatgctgtgccagcgcaggtgaacccggagcaggataatacgtatcgtacagcgcctgcgggaagccaccaaagtcatgaatcgtgggcggcatctccatcgcggtcactcctgttccacgggtaaaccaatgagccgaaaccaccactattgcttgcgggcgtggcaatgtcatccccaacgtctgccagctgcgggtatacaaattatcttccagcacgttcatcggactaccgtgacctaaaaacaatgctggcatacgtgttgaagacatgatgatatccttaactaaaggtgtcattttgatatcctcacaatacgcttgttcggcggagtaagaacccggataacaatgatgatgatcatcagttattttgacgatctgcctgaaggtaaagatttataaggagttgtcgatgtcagtacctctcattctgaccatactggcgggggcagccacgtttattggcgcgtttctcggcgttctcgggcaaaaaccctcgaaccgcttactggcgttttcgctaggatttgcggcggggatcatgttgctcatctcattaatggaaatgcttcctgccgcattagccgccgaaggaatgtcgcctgtgttgggttatggaatgtttatcttcggtctgcttggctattttggcctggaccgcatgttgccacatgcgcatccgcaggatttaatgcaaaaatcggtgcagccgttgccaaaatcgatcaagcgcacagccattctgctcactctcggcatcagtctgcataacttcccggaagggattgccacctttgtcacggcgagcagcaacctggagctgggatttggcatcgccctggccgtagcgttgcacaatattcctgaaggtctggcggttgcaggcccggtttacgctgcaacaggatcgaaacgtaccgcgattctgtgggcgggcatttccgggctggcagaaattcttggtggtgtgctggcatggttaatcctcggtagcatgatttctccggtggtcatggcggcaatcatggcggcggttgcaggaattatggtggcgctctccgttgacgaattaatgccgctcgccaaagagattgaccccaataataaccccagctatggcgtactatgtggaatgtcagtgatgggattcagtttagtgctgctacaaacggtgggaattggttaaagacgataatgacagatgttgcccattgctaaaggcaacatctgtatcgttattaaaggtattattgatgcttttcaaacacttctttatcggagcgtttatctaatttacttcggacagctaacagcgcatctctgtcatggcgaaaagctttacagtaacgtttaagatgaagaaaatagccaccagccagtagaacaattaatacaatccagtaccaggcaataaacatccttttcaccttcaaaatttaacattactaaacatttagcgttaaaatttcacatatccatcgttgaatacattcatatactcgcataattctggatcaagtatatgatttcgatcatagtaagtgttgtattatataccatatctggttaaaaaaagaacaaccaagactattaatatatattatcccccgataaaacattactaattaataataaaaattaataagcatcgctagatatatattatatcttcacgattattaagcccctactcgttataataagtatacactcccccctttacaacattaggcgtaaacctttgtcaacaaacggttgttttttcgccgcaattcatacaaaaaaattatcacaaataacgataaacaacaaatatctagatatatacacctcaatatataacggggaattatattttaagttttacttaatcagcatttaatataaataacgagtcaaattatctctggttatggtaatgtccatagctgaattaatattaaattcaaacctgtattttcctcatccatttataaaggattatagtcatgttaaaaaaaacattgttatctatgttcgcaaccgcattgttatcaggcgttgcttttaacgctcttgctgacgatgctaatcagggttcaggtaaaattacttttaaaggtgaagttatcgatgcaccttgttctattgctcctggtgatgaagatcagacaataaacctcggtgaagttgctgataccgtattaaaaagcggtcagaaatcactgcctgtagatgtcaccattcatttgcaggattgtattttatctgacggcactaacactgttgataaagtcaaaatcacctttagttctgccagtgttgacgctaccgactccaacctgcttaaaaacactctggaaggtaacatcggcggcgcaactgatgtaggcgtacgtctggtgaaatcagacaacaccaacgtgactcttggcactccaatcactatcaacttcccgacgactaactcttaccaggagttgaactttaaagcccgtatggagtctctgggacgcaccgcgaccccgggtaacgtgcaggcacaggctaattacgtactcgactacaagtaatcggtagtcaatacctacacaacgccaggcggtaaagccgatgaaatttcatcggcaactttgggcctttttagaaatggatttttatgaacaataaaaacacgttttcccgggataagttatcccatgcaattaaaaatgccctgtctggcgttgtgtgttccctactcttcgttttgccagtccacgccgtagaattcaacgtcgatatgattgacgcagaagaccgtgagaatatcgacatctctcgttttgagaaaaaaggctatatcctccctggtagatacctcgttcgtgtgcaaataaataaaaatatgttgccacaaacgttaatactggaatgggtaaaagccgataatgaaagtggttcgttactctgcttaaccaaagaaaatttgactaatttcggtcttaatacggaatttattgaatcattgcaaaacatagctggcagcgaatgtctcgatttaagccaacgtcaggagttaacgacacgacttgataaagctacgatgatattatcgctaagtgttccccaggcatggttaaaataccaggcaacaaactggacgccaccagagttttgggataccggtatcgccgggtttatccttgattacaacgtgtacgccagccagtatgccccacatcacggagacagcacccaaaacgtcagctcctatggtacgttaggctttaacctcggcgcatggcgcttacgtagcgattaccaatataatcagaattttgctgatggacgctcggtaaaccgcgacagcgaatttgcacgaacttatctgtttcgccctatcccctcctggtcgtcaaaattcactatgggccagtacgacctgagctccaatctttacgataccttccactttactggcgcatcgctggaaagtgatgaaagcatgctgccgccagatttacagggttatgcgccacaaattaccggcatcgcgcagaccaacgcgaaagtaactgtggcacaaaatggtcgtgtactttatcaaaccactgtcgcgccaggcccttttactatttctgatttggggcaatcgtttcaggggcagctggatgtcacagtggaagaagaagatggccgcaccagcaccttccaggttggctccgcatccattccctatttaacccgtaaagggcaagtgcgctataaaacgtcactgggaaaaccgacatccgtcgggcataacgatatcaataatccctttttctggacggcggaagcctcctggggctggctgaacaatgtgtcgttgtatggtggtggcatgttcaccgctgatgattatcaggctatcactaccggtattggctttaaccttaaccaattcggttcgctttcttttgatgtcaccggagcagacgcgtctttacagcaacaaaatagcggcaatctgcgtggttacagctatcgcttcaactatgcaaagcatttcgaatcgacaggcagtcagattaccttcgcgggttatcgcttctcagataaagattacgtgtcgatgagtgagtacctcagctcgcgtaatggcgatgagtcaatcgataatgaaaaagagagttatgtcatttccttgaaccagtactttgaaacgctggaattaaactcttatctcaacgttacacgcaatacttattgggacagcgccagcaataccaactactccgtatctgtaagcaaaaactttgatattggcgatttcaaaggtatatctgcatcgctggcagtaagtcgaatccgctgggatgacgacgaagagaatcaatattacttctctttctctctacctttacaacaaaaccgcaacatctcctacagtatgcagcgaacgggaagcagtaatacttcgcagatgatttcctggtacgattcatcagatcgcaacaatatctggaatatttcagcgtcggcaacggacgacaatatacgtgatggcgaaccaacactgcgcggcagctaccagcactattcgccgtggggacgtctgaacattaatggcagtgtacagccgaatcagtacaattctgttaccgcaggctggtacggttcacttaccgctacacgtcatggtgtcgcccttcacgattatagctatggcgataacgcccgcatgatggtcgataccgatggcatctccggcattgaaatcaactctaaccgtaccgttaccaacgggctgggcatcgccgtgataccttcgttatcgaactacaccacctccatgttgcgggtgaacaataacgatctgccagaaggtgtcgatgtcgaaaactcggttattcgcaccacgctcacccagggtgccatcggctacgcaaaactgaatgccaccaccggttaccaaatcgtcggcgttattcgtcaggaaaatgggcgcttccctccactaggtgtgaatgtcacggataaagcgacaggtaaagatgtgggcctggtcgcggaagacggcttcgtttatctcagcggtattcaggaaaatagtactctgcatttaacctggggtgataatacctgtgaagtcacgccgccaaaccaaagtaacattagcgaaagcgcaataattttaccttgtaaaacagtcaaataattcaggatgaatataatgaaatcaccattaatcacaacaggaatgatttgtttactggggatctgcaactttgcccaggcgactgtctcccccgacagaacacgcatcatttttaatgcttcgaataaaagcgcaacggttcgcctgaccaaccaaagtaaaatcgatccctatctggctcagtcgtggattgaagatgccagcggtaaaaaaacgcgtgattacatctcgacattgccgccgatggaacgtattgagcctgatgaacagatacaaattcgcctgatggcactggcctcgttaaacgacttaccacaggaccgagaaacgttgttctactataacgtgcgagaaattccgccgcgcgccaaagaacagaatgtaatgcaaatcgccatgcaaagccgcctgaagctattctggcggccaaaagcgattgagttaaaagagggggagatgattcctctgcaaaaagtaacgattacccgcaccgccgccggtctgaccctgaataacccgacgccttatcatattaccgtcggttatatcggcactaatggcaagacactgatgcccggtgcggacagtattatggtggcaccatttacttctgcaactcaacacctaagcagcctgccctctaccttccagttaggctttgtggcggactacggcgggctggagatgtttaaagtcgaatgtagttccatccaatccctctgccaaagctctcctgctaagaaggggaaaatatgattacgctttttcgtttactggcgattctttgcctgttttttaatgtttcagcttttgctgttgattgctatcaggatgggtacagaggaacaaccctcataaatggagatttaccagcgttcaaaattccagagaacgcgcaacctgggcaaaaaatttgggagagtggagatattaatatcacggtttattgtgacaatgcaccaggatggacaacagacaatccatcagaaaatatctatgcctggatcaaattaccccaaataaatagtgccgacatgttgaataatccatatttaacctttggcgtgacttataatggtgtagattatgaagggataaatgaaagaattgatactcatgcatgcctggataaatatgagcaatactataatgggtattattatgaccctgtatgcaatggcagtacccttcaaaaaaatgtaacatttaatgcccattttcgcgtctatgtaaaattcaaaagccgcccagcaggagatcagacggtgaactttggcatagtcaacgtgttacaattcgatggcgaaggaggggcaaacatgtcctctaacgcgaagaatttacgctatgtgattacgggattagataatatttcattccttgactgtagtgtcgacgtccggatttttccagaaagccagatagttaatttcgggcaaattgctgcaaactctattgctacttatcgaccaaaagctgcatttagcgtatctactataaaagatgttgctgccgattgtaccgagcaatttgatgttgccaccagcttttatacgacagatacgttacatgatgatacgcatctggaaatgggtaatggtttgttgatgcgtattactgatcaaaaaacacaagaagacattaagtttaatcagtacaaacgcttcaccacatatattccaggtcagactggagcgatggttacccgtgattaccaggctgaactttcacaaaaaccgggggagactctcgtttatgggcctttcaaaaaagatctcatcgtaaaaataaactataactgaacagcaaaatgccgggaacaccccggcattttcatatttagtatttcacgtcattagctggctttacgctcatgtgcctgacggtatgccaccaggtcttcaatagtcacgagcgccatattgtgtttattggcaaactcaatgcactctggtgcacgcgccatcgtgccatcgtcattagtcagctcacacagcacaccagctggtttaaagcctgccagcgtcatcagatcgatagtcgcttcagtatgaccgccacgcgtcagtacaccacctgcctgcgcgcgaagtgggaaaacgtggcccggacgattcagatctgaaggttttgcgccatcggcaatcgctgcgcgaacggtcgtaatacggtcagcggcagaaacaccggtagtcacaccttcagctgcttcaatggtcacggtaaaaccggtgccataggcgctggtgttattttctaccatcattggcagatcgagttgtttacggcgatcgtcagtaatgcacaggcaaacaataccactcccgtggcgaatggtcagcgccatctgctcaacggtcatggtttctgccgggaagatcatatcgccttcgttttcacggtcttcatcatcaagcaccatcacaccgcgtccttcacgcagcgcagccagtgcattttcaacacgttcgaaaggcgtaccaaaagaggaaagtagcgtctgattcatggtaaaaaaacctcactaaaattatggttaccagaatcagggcagtcttaggagtggcggcatatagccaaaataacgtgagcgggtccatgcccgacagaatcgttactctctcccatccggactctaaccgtcggccccggaattacaccggatctgctgtcctttgagttcgcacccaaagcgctcgcgggctttcaactgagttgatttaccgccggtggggaatttcgccccgccctgagaataagcggattcactataacgctaatgattagcgccagcaacgcatagcttcacataattctggtttatgacttacccttatcgcactacaatggcactcaacacctatcagtacagggaaactacaatgattgacccgaaaaaaattgagcaaatcgctcgccaggttcacgaatcaatgcctaaaggaatcagggagttcggggaagatgtggagaaaaaaatccgccaaaccctacaagcgcagctgacgcgtctcgatctggtaagccgcgaagaattcgacgttcagacgcaagtcctgttacggactcgtgaaaaactggcgttactggagcagcgcatcagcgaactggaagcgcgcaataatccgatagcagaacttcaatctcctccggctatcccgccagttgataaagcagaataaagcaccacaaaaacgggccagacggcccgtaatatcagtgttctaattcaagttctctggtttgcatcatctgttggcaataccaggcataacgcgcgcaaaaccaggttctatgttcttcatccatgttaccagtaacggccagaatatcgaccgggcgaccttctgcgtgcattctggcaaaactacgcgcgagaaaatcgaaattatttaaagaattaagactatgatccataagcacatcctccggttattgcataccttttaaggccatatgctttttctgatttcagtattccccaatcagtgtagtgcctttaaacataacgtgcgtaaatatattgtccccgatcacactttttagtgaaaaataaaaaaaccatattaaaagactttctcttccagaacctctctaacatgtgttattattaacaaagacaaatgtaagcaaggaaactattccaaagtaaatattgcgtcactaaatggacattggagtgacatatgattttattcgccgactataacaccccttatcttttcgctatttcctttgtactcttgatcggccttttagaaatttttgcacttatctgcggtcacatgctctccggtgctcttgatgcacatcttgaccattatgattccataaccacaggtcatattagccaggcacttcattatctcaatattggaagattaccagctctcgtcgtcctctgcttactcgctggtttttttggtcttattggcatcctgttgcaacatgcctgcgttacgctctggcaatcaccactccccaacctgttcgtggttcctgtcagtttactgtttacaattattgcagtgcattataccggtaaagtcgttgcaccctggattccacgcgaccatagttcagctattacagaagaagaatatgttggtagcatggcattaattaccggccatcaagccacttcaggtaacccttgcgaaggaaaactcaccgatcaatttggccaaatacattatttgctactggagcctgaagaaggaaaaactttcactaaaggagacaaagtgttaattatttgccgactttctgcaacgcgatatttggcggaaaataatccctggccccagatattgtgatttattaatcaaaaggaaatttaataatggatgatatcgttaattctgtgccctcctggatgtttaccgcgattatcgccgtatgcattctgtttattattggaattattttcgccaggctctatcgtcgcgcttcggcagagcaagcatttgttcgtactggtttaagtgggcaaaaagtggtgatgagcggtggcgcaatcgtgatgccgatctttcatgaaataattcccatcaatatgaataccctgaagctggaagtcagccgctcaaccattgatagcctgattacgaaagatcgtatgcgcgtcgatgtcgtggttgctttctttgtgcgggtaaaaccttcagtagaaggcatcgccactgcggcccagacgctggggcaacgcactctatcaccagaagatttacgtatgctggtcgaggataaattcgtcgatgccctacgcgccaccgctgcgcaaatgaccatgcatgagttacaggatacccgcgagaacttcgtgcagggagtacaaaataccgtagctgaagatctgtcgaaaaatggcctggaactggaaagcgtttcacttaccaactttaaccagacgtcgaaagaacatttcaatcctaacaacgcctttgacgccgaaggtttaaccaagctgacgcaggagacggagcgccgtcgtcgcgaacgtaacgaagttgaacaggatgtagaagttgcggtgcgtgagaaaaaccgtgatgcgctttcgcggaagctggagattgaacagcaagaagcgtttatgacgcttgagcaggagcagcaggttaaaacccgtaccgctgagcagaatgcgaaaattgcggcttttgaggccgagcgtcgtcgggaagcagagcagacgcgaattctggctgaacgacagattcaggaaacggaaatcgaccgcgaacaggccgtccgttccagaaaagttgaagctgaacgtgaagttcgcattaaagagatcgaacagcagcaggtcaccgaaatcgccaaccagacgaaatcgatcgctattgccgccaaatcggaacaacagtcccaggcagaagcgcgtgctaaccttgcactcgcagaagcagtaagcgcccaacaaaacgtagaaaccactcgccagactgccgaagccgatcgtgctaaacaagtggcgttgatcgccgcagcgcaggatgcagaaaccaaagcggttgaactgaccgtgcgggcgaaagcagaaaaagaagccgcagaaatgcaggcggcggctatcgttgagttagccgaagctacacgtaaaaagggtctggcggaagcagaagcacaacgtgcgctgaacgatgctatcaacgtactttctgatgaacaaaccagccttaaattcaaactggcattattgcaggcgctgcctgcggtaattgagaaatccgtggaaccaatgaagtctatcgacggcatcaaaattattcaggtcgatgggctgaatcgtggtggcgctacgggtgatgcaaacacgggtaatgtggggggcggaaacctggcagaacaagcgttatcagccgcactctcttaccgcacacaggcaccgctgattgactccttgctcaatgaaattggcgtttcaggcggctcactggcggcattgacttcatccttaagctcaacaactcccgtcgaagaaaaagcagagtaaaccctcttctatgaataatccctggcccaaaaagccggggattttttatatctgcgttccgctaaaaggtgcaaatgatcaggctgttgcagcattttgcgtgactgctcggggaaggtaaaactgcctctgggaaagcgttgcgcggggtccggcgctcatcaacaatcggggagtcagcaaggggctgaaacgggaaagcccctcccgaggaaggggccttatagaaggaaagggttatgatgaagttcgtcatcatactggttgtgttgttactgttaagtttcccgacttactaacaactcatcagaggggggagaaatcctcccttacccttgttcctttactttaggttgaaaaaacaacagcgtcaataggcctgcctgctacgaagcgagatctgtgaaccgctttccagttagccttttttatccagttggatcttcttgatgatgttggtcgtcgagcaaccgtcttcaaagttgagcaccagcacttcgccaccgttggcccagacttctttactcccggcaatctcttctggtttatagtcgccgcctttcaccagcagatctggcaagatcccggcgatcaagcgctgcggcgtgtcctcttcaaacgacaccacccagtcgaccgcttccagtgcgcccagcacaatcatacgctgttcgagcgggttaacggggcgggaatcccctttcagccgtttggtggaggcatcgctgttcacagcgacaatcaaacggtcacccagtttacgggcatttgccagataagagacgtgcccggcgtgcaggatgtcaaagacgccattggtcatcaccactttttcaccgcgtttacgcgctgccgctacagcaagcttcagttcctcttcggtcatcacgccaaagccggtatctgcacgtccacgtactgcattttccagctcgatcggcgaaaccgtggatgtccccagtttgccgaccaccacgcctgccgccgcattggcaaagaagcaggcttcttccagtgaattacccgcagccagcgttgccgccaggacgccaatcaccgtgtcgcccgcaccggtaacgtcatacacttcctgcgcctgggttggcatatgcagcggcgctttacccggttgcagcagcgacataccctgttcggaacgggtcactaacagagccgagagttcgtaatcggcaatcagtttcatgccgcgctcaacaatctcttcttcggtcttacatttaccgacaacagcttcaaattccgagagattcggcgttaacagcgtagcgccgcggtagcgctcaaaatcggtaccttttggatcaatcagcactggaacacccgctttacgcgccagttggatcatctgctgtacgcttgccagcgcacctttggcgtagtcagaaagcaccagcgcgccaatcgaactcagtgcctgattaatccgctcgtgcagcggctgcggatcaaccccttcgaaaccttcttcgaaatccagacggatcagctgttggttacgggaaagtacccgtaatttggtgatagtcggatgcgtcggtacagaaacaaagtcgcatttgacgttgacgtcggccagagatttactgagcgcgcgcgccgcatcgtcaatgcccgtcaacccgaccaggcgtgcattagcaccgagagaagcgatattcatcgccacgttagccgcgccgcccggacgttcttcgatggtattcactttaaccacgggcaccggcgcttccggcgagatacggctggtgggaccgtaccagtaacgatccagcatcacatcaccaaccaccatcactcctgcacgttcaaactctggcagcgttactttcattcctgtctcctgagagattcaaaatttgcgcgcgataataccatacttcattcttccaccagccacttctgccagcttgcccgcaccagttcacgctctgcggtgaagcaatcctccgacacatggcccggcaattcctgtaatgccagatgatgaagttcatcgcgcagcgtcgtgtaagcacgggtcagcgccatcgcttcctgctcttccataatgtcgttttgcgccagtagttccagaatgcgcacgttgtctgaccagcgcgttaacttcggtttttcgtgagcgtagcgcaacaccagatattgagtaataaattcgatatcggtaattccgccttcatcggctttgatatcaaagcgatcgcgatgtttattgccgagatgggcacgcattttctcgcgcatttcccgcacttctgtttgcagggttttgccttcgcgcggcagcgtcataatctcccggcgtactgcgtcaaagtgcgcggtgagctgcggatcgccgtacactacacgcgcacgcaccagcgcctgatgctcccacgtccaggcctcgtttttctgataatcagcaaatgcttctgcggatgtcaccagcattcccgccgccccggacggacgcagtcgtgcatccacttcatacaaaatgccggaagaggttcgcgtactgaacagatgcataatgcgttgcgccagacgcagataaaactgtcgcccgtcgatttcccgctcgccgtcagtcatcgcatccattgggcaatcatggaggaagatcaggtcaagatcggaactgtagcctaactcccagccacccagcttgccgtagccgaccaccgcaaaaccacgcccttcgcgttcgttcaggtgatttggcttaccgtagcgggcaaccatttgaacccacgcctgctgaacgacggcatcaatcatggcttctgccagccaggttaagtgatcgctcactttcattaccggtagcgtaccggcgatatccgctgccgcaatgcgtaacagctgcgcctgtttgaactgacgcagcgcctcaagctgttgttcttcgtcatcttccggcacgcgcagcaaatactggcgcagttcatcacggtaggcatccgtcgccgttggttggtagagggtatttggatcgagcaattcatccagcaataatggataacgcgctagctggctggcaatcatcggcgatgcagcacacagagaaatcaaatgcttaagcgccgcagggaattcactaagcagctcaagataagtggtgcgagtaacaatccccaccagcaaggcggtaatgcgcgacagcgtgacagcagcgtcttcacgcgcacagacatcacttagcagatgtggcatcagatggtcgagcacctgacgtcctcgcggcccgatggtgcgcttatccagctctttgcggaaatcagcaatcagcattagcacctgtttgcgatcatcctcgctaagatgcgccagcactggcgtggtgtcatcttcctgcaacgcatcctgccacagctcacgccactgttccgacagcgactcttcctgagtttcactttcgtcgtcgccaatcaattcattaaacacccggcgcacattggccatatgtgcggtcagcaccccggtcaattgcggccagtcagcaaagtccatcgcccacgccagccgcgcacggttaagctcatcaaaaggaagcgtctgggtttgttcgtcgttaatgctttgcagcaggttttccagacgtcgcaggaacagatacgccactcgcaattgttcagcatcgttttcagaaagcagatgcagcgcggcaatggcgctgagcgttggcagtaaagagcgcgattgcagcgacggttcgcgcccgccgcgaatgagctggaacacctggacgataaattcaatttcgcgaatgccgcctgcgccaagtttgatgttgtcggtcaaaccgcgtcgacgcacttcacgggcaatcattcctttcatgttgcgcagcgactgaatcacgctgaaatcgatgtaacgacggaaaacaaacggacgcagcatcgcacgcaactcgttagcatagacgccgtcgctatcccccataatccgcgccttgaccatcgcgtaacgctcccagtcgcgcccctgctcctggtaataatcttccagcgccgcaaaactcagcaccagcgggccactttcaccaaacggacgcagccgcatatccacgcgatagacgaagccatcctgcgttggttgatccagcactttaatcagccgctgccccatgcgggtaaaaaactgcgcgttatccagttcccggcgtccaccctgggtacaaccatgttccggccaggcaaaaatcagatcgatatcagaggagaaattcagttccccgccgcccagcttacccatgcctaaaatcagcagcggttgcgcttcgccctgcgcattgcacggcgttccccattcgcggcagcaggcgtcatacagccagtcacgcgccgcaacaatcagcatctccgccagatggctgagctgctgcaatatgctctcttcagtaaccagagccagcgtttgcgcccaggcgatgcgcaccataatgcgccgccggaatagccgcagctcgcgcattaacccggcttcgtcactcacattactgagcgcctcctgcagccatgcagcgtaatgctgccattcgtcggcctgcggcggttggctttccagttccgtcagccactctggatgcgcaatcacgctgtcctgcacaaaatcactgaaagtaagtactgacttcgcctgtgcgctaagtgattcctcggctaaaggctctggcagccgctcaacaacggtctgccagtactgctgtaacggtgaagagagcggcttcataagcgattttatccttgcctgattaacgttttccgctgtgcaaccagaacggttcctgattgtttgcctcattacggaaatgttcaatttcaatgcgttgcccggtcgcaatagcgtgacgcagcccctgccagttctccagccaggcttgcgcgacgacaggatcgtagtaacccgccagcaacagtattgagtcaatatcacgcgtcaggcgtggcaattggtcacggtagcgatcgcctaacggctggcagaaaacgcttttaagttcagcagcatggcgggaaagatggatatcggcaaagcgtttgaaggaatcgctgattttgctctgcgctttggcatctaaaaacggctgccaggctttgcttaccagccattcggtcaacgccagcttcgccattgccgtttcggtagagtagaccgccgttacggcagaaaccgcagaagcaatggtcgcctcgcattgagtcagcagatcacgtaagtgagtgctcgctttacgcggcacgataccgccgaacagcatcagtgtatgacggaccaggccaatggctgccagcacctgctctttcgccgcatcgttgccgcgtacccacagttcttcatgatactgccattgcgctaacgccagctcgaacgccgcttccagcccctgttccacatcagcttttgccgctacatgcaaaatggtggtcggtttgatttcacgcgccggattgccctgcgccagatgatagccacgcgctgctttgctcaggctgccctggcgtaatccggtttgcgataccagttggttcgccagtttcagcaccgcacgcatgtcgccgctaagcagttccagttccagctcacagataggttcagcaaattcacccgctttcacctcaccctgatcgaaagcgatttcaattcggctgccatcgacctctactagccatttttcgcgataaaaatcggtgctaaacagcggctgtacgcgggaagcgagatcggcaggcaattcgccgtgcggccagacttccgtcggtaactgcgccaggtcgagcgtcggttcgctcaacgccacgttatattccgggcgctggtgtaagccgcctgtcactcttcctgcaactttcatggtcatctcatagcgaccgttttcgccacgaatacgcaagcccatgtcgtgcccacgcagccagttatccggcgtttcgtagtaaatattcagcaactgcacggggtcatggtgctcgccgcccagcgtattgagatggtcacgcaacgcctcaacggcactgtgattaacaataaactttaattcgatttcctgagccatagcctttacttatcggttatgtcacataagtgacgatgaacggcgaacttaatgcgatcttttttgtcagtagatagtattttgcgccaaattgccatgcaacgggcaatttgacgggcgtaaaagtttgaagcagtggcaagacctgacacagaggattccgattgatgtcgaatgctttgcgtagcgacactgatgccactactatcgttccactttccatgacaataacgacagcctgatgccaaaattacgcctgatcggattaactttactcgcacttagcgccactgccgtctcacacgctgaagaaacgcgctatgtttctgatgaactgaatacctgggtccgtagcggtccgggagaccattatcgcctcgtgggcacggttaacgccggcgaggaagtgaccttattacaaactgacgccaacaccaattatgcccaggtgaaagacagctctggtcgtactgcctggatcccgttgaaacaacttagcacggagccaagcctgcgttcccgtgtgccagatctggaaaatcaggtcaaaacgctgaccgataaactcaccaatatcgataacacctggaatcagcgcaccgcagaaatgcagcaaaaagtggcgcagagtgacagcgtgatcaacgggttaaaagaagaaaatcagaaactgaaaaacgagctgattgtcgcgcagaaaaaggtcgatgccgccagcgtacagttggatgacaaacagcgcaccatcatcatgcagtggtttatgtatggcggtggcgtgctggggcttggcttgctgctcggtctggtactgccgcacctgatcccaagccgcaaacgcaaagatcgctggatgaactaaatcgccttcttcgttgcactgtcttattattaggaattgtgtatttgacgaagggatgatggcgtgaagatttatctggtcggtggtgctgttcgggatgcattgttagggctaccggtcaaagacagagattgggtggtggtcggcagtacgccacaggagatgctcgacgcgggctaccagcaggtaggccgcgattttcctgtgtttctgcatccgcaaacgcatgaagagtatgcactggcacgtaccgaacggaaatccggttccggttacaccggttttacctgctatgccgcaccggatgtcacgctggaagatgatcttaagcgtcgcgatctgaccattaatgcgctggcccaggacgataacggcgagattatcgacccgtacaacggtctgggcgatctgcaaaatcgtctgttgcgccatgtttcccccgcttttggcgaagatccgttacgcgtgttgcgcgtagcgcgttttgctgcgcgttatgcccacctcagtttccgtattgccgatgaaactctggcgctgatgcgcgagatgacccatgcgggtgaactggaacacctgacgcctgaacgggtatggaaagagacggaaaacgccctcaccacccgcaatccccaggtgttcttccaggtactgcgcgattgcggcgcactgcgcgttttattcccggaaattgacgccctgtttggcgttccggcccctgccaggtggcatccggaaatcgacaccggtattcataccttaatgacgctctcaatggcggcgatgctgagtccgcaggtcgatgtccgtttcgcaacgttatgccacgatctcggtaaaggactgacgccaccagaactttggccgcgtcatcatggtcatggcccggcgggtgtgaagttagtggaacaactatgccagcgtctgcgcgtgccaaatgaaattcgcgatttagccagactggtggctgagtttcacgatctcatccacaccttcccaatgctgaacccaaaaaccatcgtcaaactatttgattccatcgacgcctggcgtaaaccgcagcgtgtcgagcaactggcgctgaccagcgaggctgatgtgcgcggcagaaccggttttgaatcagccgactacccgcaaggccgctggttgcgcgaagcctgggaagtggcacagtcagtgccgacaaaagccgtcgttgaagcgggatttaaaggtgtggagattcgcgaagagctgacccgccgccgaattgcagcggtagccaactggaaggaacaacgctgcccaaagtctgagtaattgttggatattttgccggatgcggcgtaaacgccttatccggctacatatcaacgacggttgtaggcctgataagacgcgcaagcgtcgcatcaggcgttgattgtcggatgcggcgtgaacgccttatccggcctacgcaatcgaggacaattccaggcatccgacactattcttcacatcaaaagaacacgacgtacaccgcagccgccacaataaagcgataaatggcgaatgggataaacgaaatccgcttaattaattgcaggaaggttttaatcgctatcagcgccactacgaaagcagtgataaacccaacagcaaacatcgggatatcgccggtggtcaggaagccccagcttttgtagagatcaagcgccgttgcgcccatcatcatcggcaccgccagcaggaacgagaactcggaagcagcgtaacggctcacccccatcagcatcccacctgaaatggtcgccccggaacgggagaaacccggccacagcgccagacactggaaacagccaatcataaacgcctgacgataggtcatatcatcaagacccggcgcacgcggctctttcggcttcaggcattcggcggcaatcagcaacagaccgccaaccaccagcgcatacatcacatttatcgggttaaacaatgacttaatcgtgtcgtggaacaacagccccagtaccaccgccggaatcatccccagcaaaatgtggatcagcgttaaacggcctttgctttctccttcgtgctgcaacgggcgaccaaagtgaataccaataaggccaaacagacgtcgccagaacatgacaaccactgccagaattgatcctaactggatcacgacttcaaaggttttcgccgtgtcgccctcaaaccccaacaagtgaccgacaataatcatatggcccgtgctggataccggcagaaattctgtcaatccttcgaccacacccaatattgccgctatcagcagcgagtgcatatcgctcatcaataaacccctaaattataaaaatgtaacgcttgtccgaactactgcagtatgaccaggttataaccgtttggtttaacagctgtaaaattaattattttctttcagattattgccacgctcaatgatgacgccaacattcgccgcccgcgccactgcgcctggcttgctgagtttgatacgcacccacggcgagttgaagcgtgctaacagcagctccgccacctcttcagccacgcgctccaccagcgcaaaacgcgccccctcgacgtggctgaccaccgtttctgcaatgtcagcgtaactgaggcaatccgccacatcatcacttttcgccgctttacggttatcccacgccatttcgatatcgaacactaacttctgttcgatggtctgttcccagtcgtaaacaccaatggtggtgattaccgaaagttgctctataaatacaatatccatcacgtcctgcctgctttttggctaaccggataccacttccggcgaaatgtgcgtattatccacagattcatcgttgaacacgaattttcaaaacggaacagcttatgagtgcaatcgcgcctggaatgatcctcatcgcgtacctctgcggctccatttccagtgccattctggtttgccgcttgtgtgggctgcccgatccgcgaaccagcggctccggcaatccaggcgcaaccaatgtgttacgtatcggtggcaagggagcagccgtagcagtgctgatctttgacgttctgaaaggaatgttacctgtctggggggcatatgaattaggtgtcagccccttttggctaggcttaattgccatcgccgcctgtcttggacacatctggcccgttttcttcggatttaaaggaggaaaaggcgttgctaccgcttttggtgccatcgcacccattggctgggatctcaccggagtaatggcgggaacctggttactgaccgtgctattgagcggatattcgtcgctgggggcgattgtcagtgcactgattgctccgttttatgtctggtggtttaagccacaattcaccttcccggtttcgatgctctcttgcctgatcctgctgcgtcatcatgacaacatccagcgtctgtggcgtcgtcaggagacaaaaatctggacgaaattcaaaagaaagcgcgaaaaggatcccgagtgatttctggtggatctacataacctgatagccttcgtcgggcttgcccagccgttgctggcaccatgccgccagaaattccacgcagacacgtaatttcatgctgcgatagagcggctcccggtaaacagcccagatattggcgctttgtgcatactccggcaatactcgcaccagtttgccactctccagaaacggcaacacatcccactcggaacgcagcataatccctttgccctccagcgcccattgcagcacaatctcgccgctattggaggaaagatgtccgcttaccttcaccgattttttctcctgaccgttccccaactcccatattccgtgggtcatatcgcgctctttggtcaccaggcagtcatgacgacttaattcctgtaaggattgtggctgcggatatttttgcagatactcaggtgctgcgcataatattcttttattttttgtcaaaagatgcgcaatataataatcaggaattgcgtcattaatacgaatatccagatcaatattatcctgcactaaatcaatttgtcgatcgaacaattcaaaatgcacctgtaactcaggataattgcgcatcagttcggtaatagctggcgcaatatggctgcgcccaaaaccaaaactgcaaccaatgcggatcatcccctccgggcgcgttttgatttgcgtgacgtcatcgaccagtcgctgatattgggtgaggatttccagcgcatgttcgtaacaacgctggccactttcagtcagcgccacgccgcgagcggagcggttcagcagagttgttgccagcgtattttcaaggatttggatccgcttggtgacaaatgcaggcgtttgcccaagcgtcgccgctgcagcactaaaactcccgctatggacgatttccaccagtacctgcaagtctttggctaaaggccagctatttagcattgttaaatatccgcagttttgataaacgcagtgtatttcgcaaaacattaccattccctgctctggcgcaatattcgttcttattttcgcgttgattcacgaactgttaattacatattcacggtggcaaaaaatataaaaccacatttttagtggtagtttgttgcggtgaatttttccagacaaataaagaaactggagttgccatgatgagcgaaagtaataagcaacaggcagtgaataagttgacggagattgtcgctaactttaccgccatgatttctacccgaatgcctgatgacgtggtggataaactaaaacagctaaaggatgccgaaacatcgtcgatgggaaaaatcatctaccacacgatgttcgataacatgcaaaaagcgatcgacctgaatcgtcctgcctgtcaggacaccggcgaaatcatgttttttgttaaggtcggttcccgtttcccactgcttggcgagctgcaaagcatactcaaacaagccgtggaagaggcaaccgtcaaagcgccactgcgtcacaatgcggtagaaatttttgacgaagtaaacaccggcaaaaataccggcagcggcgtaccgtgggtcacctgggatatcgtccccgacggtgacgatgcggaaatcgaagtttacatggcaggcggcggctgcacgctacctggccgatcgaaagtgttaatgccgtcagaaggctacgaaggcgtagtgaaattcgtcttcgaaaatatctccaccctcgccgtaaacgcctgtccgccggtactggtgggcgttggcatcgctacctcggtggaaaccgccgcagtgctctcgcgaaaagccattttgcgcccgattggcagccgccatcccaatccaaaagcggcagagctggagctacgcctggaagaaggactcaaccgtctggggattggtccacaagggctgactggcaacagttcagtgatgggcgtgcatatcgaatctgccgctcgccatccgtcaaccatcggcgttgctgtttctaccggctgctgggcgcatcgtcgcggcacactgcgagttcatgccgatctcacctttgaaaatctgtctcatacccggagcgcgttatgaaaaagatcctgacaaccccgatcaaagctgaagatctgcaagatattcgcgtcggcgatgtgatctacctgaccggtacgctggtgacctgccgtgacgtttgtcaccgccgattgatcgaactgaaacgtccgatcccttacgatctcaacggcaaagcgattttccacgctggccccatcgtgcgcaaaaacggcgacaaatgggagatggtgtccgtcggcccgacaaccagtatgcgtatggaaagttttgaacgtgaatttatcgagcagaccggcgtgaaactggtggtcggcaaaggcggaatggggccgctgaccgaagaaggctgccagaaattcaaggcgctgcatgtgattttcccggctggctgtgcggtactggcggcaactcaagtggaagagattgaagaggtacactggacagaactcgggatgccagagtcgctgtgggtctgccgggtcaaagagtttggcccgctgattgtctctatagatacccacggcaacaacctgatagccgaaaacaaaaagctgttcgccgaacgccgcgatcccatcgtggaagagatttgcgagcacgtccattacatcaaataaccctcacggagaggctcgcccctctcctttttctcaggcataacacgatgaaaccttccactgaatggtggcgataccttgcgccgctggcggtcatcgccattattgctctacttccgcttcccgcagggctggagagtcatacctggctctactttgccgtttttactggcgtgatcgttggactgatcctcgaacccgtgccgggtgccgtggtggcgatggtaggtatatccatcatcgccattctttcgccgtggctgctgtttagcccggagcagctcgcccagccaggttttaagttcaccgccaaatccctctcctgggcggtttctggtttttctaattcagttatctggcttattttcgccgcctttatgtttggtacgggctatgaaaagaccgggcttggacgtcgcatcgcgctgattctggtgaaaaaaatggggcatcgcacgctgtttctcggctatgcagtgatgttctccgaactgatactcgcgcctgtaacaccgtccaactcggcgcgtggtgcggggattatctatcccatcatccgtaacctgccaccgctctatcaatcacaaccaaacgacagcagttcgcgcagcattggctcgtacatcatgtggatggggattgttgccgattgcgtgaccagcgccattttcctgacggcgatggctccaaatttgctgttaattggactgatgaaaagcgcatctaacgccacgctgagctggggcgactggttcctcgggatgttgccgctcagtattttactggttctgctggttccctggctggcttacgtgctgtacccggcgatactgaagtctggcgatcaggtgccgcgctgggcagagacggaactgcaggcaatgggcccgctctgttcgcgtgaaaaacggatgctggggctgatggtaggcgcactggtgctgtggatttttggcggtgattatatcgatgccgcgatggtcggttacagcgtggtggcgctgatgctgcttctgcgcattatctgctgggacgacattgtcagtaataaagcggcgtggaacgttttcttctggctggcctcgcttatcaccctcgctaccggactcaacaacaccggttttattagctggtttggcaaactgttagcaggcagcttaagcggttattcgccaacgatagtgatggtagcgttgattgtggtcttttatctgctgcgctacttttttgccagcgccacagcgtatacctccgctctcgcaccgatgatgattgccgccgcgctggcgatgccggaaatcccgctgccggtgttctgcctgatggttggtgcggcaattggtctggggagcattcttacaccatacgccaccggacccagtccgatttactacggcagtggttatctgccaacggcggattactggcgactgggggcgatttttgggctgatattcctcgtattgctggtgattaccggcttactgtggatgcccgtggtgttgctttaagtgaggacggtgccggaaattgctctccggcacccaatagttttacgcagccggtaactccgccagcggccagcgcggacgcacactcacgccgagatccgccgtcgcgcctgctttaaaccgcaccattccggcataggcgatcatcgcaccgttatcagtgcaaaattccggacgcgcgtagaacacttcgccacgacgctttttcatcatttcagccagcttcgcccgcagtgtgcggttagcactcacgccgcctgccatgaccagtcgcttaaagcccgtctgatccagtgctcgcttacacttaatcatcaacgtatcgaccactgcatcttcaaaggcgcgggcgatatcggcacgcgtctgatcgtcagtgccgttgtcacgtatggtatttgccgcgaaggttttcagaccagaaaagctgaaatccagccccggacggtcggtcatcgggcgcgggaagacaaagcgcccggcagtaccctgagccgccattttcgacagtaatggcccgccaggataatccagccccagcagcttcgcggttttatcaaacgcttcaccagccgcatcatcgatagactctccgagcagctcgtactgaccaatgccagtcacgctgattaactgcgtatgaccgccggaaaccagcagcgcgacaaacggaaattccggtgggttatcttccagcatcggcgctaacagatgtccttccatatgatgtaccgggattgccggaacgtcccaggcaaacgccagagaacgcccgaccgttgcgccaaccagcagtgcgccgactaatccagggcctgcggtataggccacagcatcaatgtcttttgccgttaaaccagactctttcagcgcctcctggatcaacggtacggttttacgcacgtgatcgcgggaggccagttcaggcacgacgccgccgtagtcagcgtgcaatttcacctgactatacaattggttggctaacaaacctttttcatcgtcgtaaatggcgatgccggtttcatcgcaggaagtttcaatacccagtacacgcatgacttgttttacctcgctttattaccgcgcagtgtaggaccaatgcgggttgatgtaaaactttgttcgcccctggagaaagcctcgtgtatactcctcacccttataaaagtccctttcaaaaaaggccgcggtgctttacaaagcagcagcaattgcagtaaaattccgcaccattttgaaataagctggcgttgatgccagcggcaaaccgaattaatcaaaggtgagaggcacatgccggtaattaaagtacgtgaaaacgagccgttcgacgtagctctgcgtcgcttcaagcgttcctgcgaaaaagcaggtgttctggcggaagttcgtcgtcgtgagttctatgaaaaaccgactaccgaacgtaagcgcgctaaagcttctgcagtgaaacgtcacgcgaagaaactggctcgcgaaaacgcacgccgcactcgtctgtactaattccccgagagcgttgctctccgatcagaccgagttgtagttgtaaggccgtgcttccgaaaggaatgcgcggcttattttcgtttatgaattgctaaaaatcggggcctatggctggacgaatcccacgcgtattcattaatgatctgctggcacgcactgacatcgtcgatctgatcgatgcccgtgtgaagctgaaaaagcagggcaagaatttccacgcgtgttgtccattccacaacgagaaaaccccatcattcaccgttaacggtgagaaacagttttaccactgctttggatgtggcgcgcacggcaacgcgatcgacttcttgatgaactacgacaagctcgagttcgtcgaaacggtcgaagagctggcagcaatgcacaatcttgaagtgccatttgaagcaggtagcggccccagccagatcgagcgccatcaacggcaaacgctttatcagttgatggacggtctgaatacgttttaccaacaatctttacagcaacctgttgccacgtctgcgcgccagtatctggaaaaacgcggattaagccacgaggttatcgcccgctttgcgattggttttgcgccccccggctgggacaacgtcctgaagcggtttggcggcaatccagaaaatcgccagtcattgattgatgcgggcatgttggtcactaacgatcaggggcgcagttacgaccgtttccgcgagcgggtgatgttccccattcgcgataaacgcggtcgggtgattggttttggcgggcgtgtgctgggcaacgatacacccaaatacctgaactcgccggaaacggacattttccataaaggccgccagctttacggtctttatgaagcgcagcaggataacgctgaacccaatcgtctgcttgtggtcgaaggctatatggacgtggtggcgctggcgcaatacggcattaattacgccgttgcgtcgttaggtacgtcaaccaccgccgatcacatacaactgttgttccgcgcgaccaacaatgtcatttgctgttatgacggcgaccgtgcaggccgcgatgccgcctggcgagcgctggaaacggcgctgccttacatgacagacggtcgtcagctacgctttatgtttttgcctgatggcgaagaccctgacacgctggtacgaaaagaaggtaaagaagcgtttgaagcgcggatggagcaggcgatgccactctccgcatttctgtttaacagtctgatgccgcaagttgatctgagtacccctgacgggcgcgcacgtttgagtacgctggcactgccactgatatcgcaagtgccgggcgaaacgctgcgaatatatcttcgtcaggaattaggcaacaaattaggcatacttgatgacagccagcttgaacgattaatgccaaaagcggcagagagcggcgtttctcgccctgttccgcagctaaaacgcacgaccatgcgtatacttatagggttgctggtgcaaaatccagaattagcgacgttggtcccgccgcttgagaatctggatgaaaataagctccctggacttggcttattcagagaactggtcaacacttgtctctctcagccaggtctgaccaccgggcaacttttagagcactatcgtggtacaaataatgctgccacccttgaaaaactgtcgatgtgggacgatatagcagataagaatattgctgagcaaaccttcaccgactcactcaaccatatgtttgattcgctgcttgaactgcgccaggaagagttaatcgctcgtgagcgcacgcatggtttaagcaacgaagaacgcctggagctctggacattaaaccaggagctggcgaaaaagtgatttaacggcttaagtgccgaagagcgatcgggaagcccccgacagccgcactgagaggcagcggcaaatatataagtacgccctcgtaattatcgttggcggtaaacaaccgttggatttcagcgttaacggctgaaggacatcgggtcaatcgcccaacaccaacctcatgaaataagtgtggataccgtcttatggagcaaaacccgcagtcacagctgaaacttcttgtcacccgtggtaaggagcaaggctatctgacctatgccgaggtcaatgaccatctgccggaagatatcgtcgattcagatcagatcgaagacatcatccaaatgatcaacgacatgggcattcaggtgatggaagaagcaccggatgccgatgatctgatgctggctgaaaacaccgcggacgaagatgctgccgaagccgccgcgcaggtgctttccagcgtggaatctgaaatcgggcgcacgactgacccggtacgcatgtacatgcgtgaaatgggcaccgttgaactgttgacccgcgaaggcgaaattgacatcgctaagcgtattgaagacgggatcaaccaggttcaatgctccgttgctgaatatccggaagcgatcacctatctgctggaacagtacgatcgtgttgaagcagaagaagcgcgtctgtccgatctgatcaccggctttgttgacccgaacgcagaagaagatctggcacctaccgccactcacgtcggttctgagctttcccaggaagatctggacgatgacgaagatgaagacgaagaagatggtgacgacgataccgccgatgatgacaacagcatcgacccggaactggctcgcgaaaaatttgcggaactgcgcgctcagtacattgtaacgcgtgacaccatcaaagcgaaaggccgcagtcacgctgccgctcaggaagagatcctgaaactgtctgaagtattcaaacagttccgcctggtgccgaagcagtttgactacctggtcaacagcatgcgcgtcatgatggaccgcgttcgtacgcaagaacgtctgatcatgaagctctgcgttgagcagtgcaaaatgccgaagaaaaacttcattaccctgtttaccggcaacgaaaccagcgatacctggttcaacgcggcaattgcgatgaacaagccgtggtcggaaaaactgcacgatgtctctgaagaagtgcatcgcgccctgcagaaactgcagcagattgaagaagaaaccggcctgaccatcgagcaggttaaagatatcaaccgtcgtatgtccatcggtgaagcgaaagcccgccgtgcgaagaaagagatggttgaagcgaacttacgtctggttatttctatcgccaagaaatacaccaaccgtggcttgcagttccttgacctgattcaggaaggtaacatcggcctgatgaaagcggttgataaattcgaataccgccgtggttacaagttctccacctacgctacctggtggatccgtcaggcgatcacccgctctatcgcggatcaggcgcgcaccatccgtattccggtgcatatgattgagactatcaacaagctcaaccgtatttctcgccagatgctgcaagagatgggccgtgaaccaacgccggaagaactggctgaacgcatgctgatgccggaagacaagatccgcaaagtgctgaagatcgccaaagagccaatctccatggaaacgccgatcggtgatgatgaagattcgcatctgggggatttcatcgaggataccaccctcgagctgccgctggattctgcgaccaccgaaagcctgcgtgcggcaacgcacgacgtgctggctggcctgaccgcgcgtgaagcgaaagttctgcgtatgcgtttcggtatcgatatgaacaccgaccacacgctggaagaagtgggtaaacagttcgacgttacccgcgaacgtatccgtcagatcgaagcgaaggcgctgcgcaaactgcgtcacccgagccgttctgaagtgctgcgtagcttcctggacgattaatcggtaggccggatcaggtgttacgccgcacccggcactagtccctccgcacaaacgccaccttttcggtggcgtttttatcgcccacgcaccaccagcgcctggtccagctcgcgatacgcttcaaccagtttctccagtgaaacgcgacttaaaccgctgggatttggcaggacccaaatctgcgtcgaaccaatggtgagagtttgtttcccccactgtgcaccgcgctggctgaatccctgttcatatgcttgtttgcccagaatcgccaacgcctgcggctgataatcttctattttttcaattagcttacgcccgcctgcgtgcagctcctgctttgacacttcattggcttgcaccgttggacggtctaccagtttggtgacgccacaacgataatccagcagatgctgtgcctcctgcggcttcaactgacggtcggtaaacccggcctgatatatcaccttccagaagcggtttgccggatgagcaaagggaaaacccgttccggcggatgaaagaccagggttgataccgcaaaacacgacccgtaaccctggagccaaaatatcctcaaccatatttactcctttctaacatcaccaggaaaagtataacggattgaaaatacattgtttataaaaacagcaggcgcgcggtaatggctggattgcgacacggagttactttataatccgctaccatggccccttagctcagtggttagagcaggcgactcataatcgcttggtcgctggttcaagtccagcaggggccaccagacatagcaaaggctgacgagaaatcgtcagcctttttctttttatatatcagttactttgcgtgccagtaagccgccgcgcgtacccgctgtgggtcatactgttccgcttcaaagcgacggcttaaattcttaacgactttgccttcgccggttatccagatgaagtaatcatcggcagggatttgcatctgcgccagacgcgcatctaccgcctgctcatcatgtgccagccattcgatattaaaaccatcaaggtgcgcgagataatcctgacaggcgttatcccgcacgctaaccagcgcgctaacttgcggtttaacggcaagtttgctcaacgtttccaggcggcggcgcagtgcgggcattccggattcatcgcagacatacagctgatacgcgtaatcctctggcaccaccagcgaaccgcgcggacctgccaccgtgagtttatcgcccgattgcacctgcattgcccagctgctggcgacgccaccttcgtgaataaagaaatcaatcgccagttcatggcgtagttcgtcatacagcggcgtatagtcacgcgacggtgggcgtggtccttccggccagacgatgccctcttccgttaccgttggcggcacaaagtgagcgtcaggttgaggaaagaagagtttgctgtgatcgtcaaagccgcgcgatgtaaaaccgtccagcgcctcgccgccgaggacaatgcgctgaaaaccggcgctgatgcgctcaacgcgtaacacagtcagttcacggaagcgcagatcattgcgaacgcgctgcgggtagcggggggagttattcattgttatcgccttcgtgatggtaatcagatatatctaaataattttcgtaaatgataatgattgttaatcatgataaatgcaagcgatttgtagaactgatatgtctatagtctgataagacgaaccgcctcttctcaggcatcattactcaacgccggatgcggcgtgaacgccttatccggcctacgtgtgagatgagtccacgtttaaaaatcatttttattcttgcaagagtgctcatatcagatataaattagatatatctaattaagcaaaaggaggctgatatgagccatcatcacgaagggtgttgtaaacatgaaggccagccacgccatgagggctgctgcaaaggtgagaagtcagaacacgagcactgcggacacggtcaccagcatgaacacggtcaatgctgcggtggtcgccacggtcgcggcggcggtcgtcgacaacgtttctttggtcacggtgaattgcgtctggtgattctggatattctctcgcgcgatgacagccacggttacgagttaattaaagcgattgaaaatctgacccaggggaattacaccccaagcccgggcgtcatctacccaacgctggattttctgcaggagcagtcgctgattaccattcgcgaagaggaaggtggtaagaagcagattgcgctgaccgaacaaggcgcgcagtggctggaagaaaaccgcgaacaggtagatatgattgaagaacgcatcaaagcgcgttgcgttggcgctgcgctgcgccagaacccgcaaatgaagcgggcgctggataattttaaagcggtgctggatttacgcgtcaaccagagcgatatcactgatgcacaaataaaaaagatcattgcggtgatcgaccgcgccgcttttgatattacccaactggattaatcaccgattgccggatgcagcgtaccctacacaccccgtaggcctgataagatgcgccagcatcgcatcaggcattgtgctccaaccgccggatccggcataccgattaatgcagcaccgtcaccgcgtcttccagtcggttggcgcggtgtttcaccatcgccgacacctgcgcactctcttccactaactcggcgtttttctgggtgatcaggttaagctcatccactgcacgggtcaggctggaaagcccatcggcctgttccagcgttgaatggctaatctgagctatcaactgggtgacgttttttacctgcgccacaatatcttccatcgtccgtccggcggcgtgtacctgctgcgaaccagattgcaccttatcagcactggcatcaatcagcttgcgaatatcgttggcagcattggcgctgcggctggctaaatgacgcacttcccccgccaccactgcaaaacctttgccctgttcgccggcacgcgccgcttccaccgccgcattcagggccagaatattggtctgaaacgcaatatcgttaatcagcgaagtaatggtgccaatgcgctgggtactgtcggcaatatcgtccattgtcttgatcaccgtagtcatcgcctccccgccctgcactgccgcattactggcggtgatagaaagtttatcggcagccgacgccgtggcagagttctgtttcaccgacgccgccatttggttcatggtcgccaccgtttgctgaacgttatcaactgtctgctgggtatgttcgttcagttcatcggtgcctttcgccagcgtctcactgccgtttctgacactggacacctggcttgagacatcattaattagccaacggcacatcaggccaagctgccctaccgcacgtaatgtcagccccagctcatcgctgcgcttcagatgctcaacactattacgttctccgatcgccactttcagtgcctggctggcgacattttctatcggacgtacaatttgccattcaaaacaggcatttcccaacaacatcactaacgcacagaggaaatacgtcaccaccggggcagcgacaaaccagagcatggccgccagcacgataaacatcagggtcatcactccacgcacccgccagcgaagcggtaatgaaggcagtttacccagccagcctttacgcaccaccaggcctttatgaatacgcttactggtacgtccggcgttcaacgctttgtacagcggctccaccgccgcgatctcttcatccgtcgcccgggtacgaatcgacatatagccactgatttttccctcgcgcaccatcggtaccgcattggcccgcacccaataatggtcgccatttttgcggcgatttttcacgatgccgctccagggctccccttttttcagggtgaaccacatatccgcaaacgccgcttttggcatatccgggtgacgcaccatgttgtgcggctgcccctgtaactcttgcaaggtatagccgctcacctgcacaaaagtgtcattagcatgagtgatatagctttgcagatcggtagtggacatcagagtggtgtcgtccgccagcggggtattttgctgggtgacatacggatgagaagacatgttcgcgtcctgtgcaggttatatggttgttaacttcttgtcagagtttatgtcggccccgctgcggttatctttaaccaattaatttgatttagatcgcaatttgcgattaaagcacaaatctaattccttgatttaaaatactttcactctgttactatacgaaaacgttaattatcttgcccaaaaatcaggcaattattgccctgaaagcgtgcatttgcgcagcaatcatcaaatccatacccgacaaaaaccgtgcaaaataacagcaaatgttagcaaatagcattaaatattgcgcaaatgataaccacatttgtgtttatcccgattttcgcgatcgcagccggagtggcgcaatccctgcaatacttaaatcggtatcatgtgatacgcgagcctccggagcatattttgaacaggttaccttcgagcgcatcagctttagcgtgcagcgcccacgccctgaatctcattgaaaagcgaacgttggatcatgaggagatgaaagcacttaaccgggaggtgattgaatacttcaaagagcatgtcaatccggggtttttagagtatcgcaaatctgttaccgccggcggggattacggagccgtagagtggcaagcgggaggtttaaatacgcttgtcgacacccagggacaggagtttatcgactgcctgggaggttttggaattttcaacgtggggcaccgtaatccagttgtggtttccgccgtacagaatcaacttgcgaaacaaccgcttcacagccaggagctgcttgatccgttacgggcgatgctggcgaaaacccttgcggcgctaacgcccggtaaactgaaatacagcttcttctgtaatagcggcaccgaatccgttgaagcggcgctgaagctggcgaaggcttatcagtcaccgcgcggcaagtttacttttattgccaccagcggcgcgttccacggtaaatcacttggcgcgctgtcggccacggcgaaatcgaccttccgcaaaccttttatgccactgctgccagggtttcgtcatgtaccgtttggcaatatcgaagccatgcgcacggctcttaacgagtgcaaaaaaaccggtgatgatgttgctgcggtgatcctcgaaccgattcagggcgaaggtggcgtaattctgccgccgccaggctatctcaccgccgtgcgtaagctgtgcgatgagttcggcgcactgatgatcctcgatgaagtacaaacgggcatggggcgcacgggcaagatgttcgcctgcgagcatgagaacgtacagccggatatcctctgccttgccaaagcgctcggcggtggcgtgatgccgattggcgcaactatcgccactgaagaggtgttctcagtcctgttcgacaatccgttcctgcataccaccacctttggcggcaacccgctggcctgtgcggcggcgctggcgaccatcaatgtgttgctggagcagaacttaccggctcaggctgaacaaaaaggcgatatgttgctggacggtttccgtcaactggcgcgggaatatcccgatctggtacaggaagcgcgtggcaaagggatgttgatggcgattgagtttgttgataacgaaatcggctataactttgccagcgagatgttccgccagcgcgtactggtggccggaacactcaacaacgctaaaacgatccgcattgaaccgccactgacactgaccattgaacagtgtgaactggtgatcaaagcggcgcgtaaggcgctggcggccatgcgagtcagtgtcgaagaagcgtaatatcaaatcggatggcgattcgacgtcgccatccgatctttttatacgatacgtacgcccgcaggcatcatccgctccggcgttaacagcacgctttcactgccgtcatcggtttccgcacacaacagcatgcattccgacgtttcaccgcgcattttcgctttttgcagattgcataagaccaccactgttttccccatcagctcttcttcgctgtagtacggcaccaagctggtcacggtttgcagcgttttttcccccacatcaacctgtacgatgtacagcttgtcggcgttttcatggcgtttcacttccacaatctttccgacacgcatttccagacgtgcaaaatcagcgtaagccacggtttccattgtttcctcccttcgagtaaaattttactaaactatagcaaaagtttttctcgatcctgtaggctaaaaatggagaatgcaggcgtgatcacattcgcaagccgctgtgttaccgttacagcgtcaaagaaacgcgctttatttactgaaaacaggtgacccgataagcacttcctctacaatgggggcgcacatcagggaaagtaaaaaaggtaaacatggcaacactaaaagacatcgcaatcgaagctggcgtatccctggcgacagtatccagggtcttgaatgacgatccgacattgaatgtgaaagaagagacgaaacatcgcattctcgagatcgccgaaaagctggagtacaagaccagtagcgcccgtaaactccagacaggcgcagtcaaccaacaccatattctggctatctacagctaccaacaggagctggagatcaacgatccttactatctggcgatccgccacggcattgaaactcagtgcgaaaagctggcgatcgaactgaccaactgttatgaacacaacggcttaccagacattaaaaacgtcaccggtattttaattgtcggcaaacccacgtccgccctgcgcgccgccgcctgtgcgttgaccgacaatatctgttttatcgactttcacgaacccggcagcggttacgatgcggtggatatcgatctggcacgtatcagtaaagaaatcatcgatttctatatcaatcagggcgttaatcgtattggttttattggcggtgaagacttacccggcaaggcggatattcgtgaggtcgcctttgcggaatatggtcgtctgaaacaagtggtacgcgaagaggatatctggcgcggcggtttttccagttcgtcgggctatgaactggcaaaacagatgctggcgcgggaagactatccgaaggcactgtttgttgcttccgattccattgctatcggcgtactgcgggcaattcatgaacgtggcctgaacatcccacaggatatttcgcttatcagcgttaacgatatccccaccgcgcgatttacctttccgccgctctccaccgtgcgcatccattccgaaatgatgggaagtcagggagttaacctggtgtatgaaaaagcccgcgatggtcgcgcgctgccgctgttggtcttcgttcccagcaaattaaaactgcgcggcacgacccgttaaatccccttgcacgctgtccggcaatcgtttttgccggacagtgctgccgtttattttcgtgatccagttaaagtaaatgcatttatccgttactttttagtaaaatttttactaaactccccagcaattacacaaactaccatcaccatgaatggttccgatttctctctaccgggaggccctatgaatcgctgggaaaacattcagctcacccacgaaaaccgacttgcgccgcgtgcgtactttttttcatatgattctgttgcgcaggctcgtacttttgcccgtgaaaccagcagcctgtttctgctcttaagcggtcagtggaatttccacttttttgaccatccgctgcaagtgccagaagctttcacctctgagttaatggctgactgggggcatattaccgtccccgccatgtggcaaatggaaggtcacggcaaactgcaatataccgacgaaggttttccgttccccatcgatgtgccgtttgtccccagcgataacccaaccggtgcctatcaacgtattttcaccctcagcgacggctggcagggtaaacagacgctgattaaatttgacggcgtcgaaacctattttgaagtctacgttaacggtcagtatgtggggttcagcaagggcagtcgcctgaccgcagagtttgacatcagcgcgatggttaaaaccggcgacaacctgttgtgtgtgcgtgtgatgcaatgggcggactctacctacgtggaagaccaggatatgtggtggtcggcggggattttccgcgatgtttatctgatcggaaaacaactcacgcatattaacgatttcaccgttcgtaccgactttgacgaagcctattgcgatgccacactttcctgcgaagtggtgctggaaaatctcgccgcctcccctgtcgtcacgacgctggaatataccctgtttgatggcgaacacgtggtgcacagcagcgccattgatcatttggcaattgaaaaactgaccagcgccagttttgcttttactgtcgaacagccgcagcaatggtcagcagaatccccttatctttaccatctggtcatgacgctgaaagacgccgacggcaacgttctggaagtggtgccacaacgcgttggcttccgtgatatcaaagtgcgcgacggtctgttctggatcaataaccgttatgtgatgctgcatggcgtcaaccgccacgacaacgatcatcgcaaaggccgcgccgttgggatggatcgcgtcgagaaagatctccagttgatgaagcagcacaacatcaactccgtgcgtaccgctcactacccgaacgatccacgtttttacgaactgtgcgatatctacggcctgtttgtgatggcggaaaccgacgtcgaatcgcacggctttgctaatgtcggcgatatcagccgtattaccgacgatccgcagtgggaaaaagtctacgtcgagcgcattgttcgccatattcacgcgcagaaaaaccatccgtcgatcatcatctggtcgctgggcaatgaatccggctatggctgtaacatccgcgcgatgtaccatgcggcgaaggcgctggatgacacgcgactggtgcattacgaagaagatcgcgatgctgaagtggtcgatattatttccaccatgtacacccgcgtgcctctgatgaatgagtttggtgaatacccgcatccgaagccgcgcatcatctgtgaatatgctcatgcgatggggaacggaccgggcgggctgacggagtaccagaacgtcttctataagcacgattgcattcagggacattatgtctgggaatggtgcgaccacgggatccaggcgcaggatgacaacggcaacgtctggtacaaattcggcggcgactacggcgactatcccaacaactataacttctgtcttgatggtttgatctattccgatcagacgccgggaccaggcctgaaagagtacaaacaggttattgcgccggtaaaaatccacgcgctggatctgactcgcggcgagttgaaagtcgaaaataaactatggtttaccacgcttgatgactacaccctgcacgcagaggtgcgcgccgaaggtgaaacgctcgcgacgcaacagattaaactgcgcgacgttgcgccgaacagcgaagcccccttacagatcacgctgccgcagctggacgcccgcgaagcgttcctcaacattacggtgaccaaagattcccgcacccgctacagcgaagccgggcattctatcgccacttatcagttcccgctgaaggaaaacaccgcgcagcctgtacctttcgcaccgaataacgcccgtccgctgacgctggaagacgatcgtttgagctgtactgttcgcggctacaactttgcgatcaccttctcaaaaacgagtggtaaaccgacatcctggcaagtgaatggcgagtcgctgctgacccgcgagccaaagatcaacttcttcaagccgatgatcgacaaccataagcaggagtacgaagggctgtggcagccaaatcatttgcagatcatgcaggagcatctgcgcgattttgtcgttgagcaaagtgatgatgaagtgttgctagtcagccgcacggttattgccccaccggtgtttgacttcgggatgcgttgtacctacatctggcgcatcgctgccgatggtcaggttaatgtggcgctttccggcgaacgttacggcgactatccgcacatcattccgtgcatcggtttcaccatggggattaacggcgaatacgaccaggtagcatattacggacgtggaccgggcgaaaactacgccgacagccagcaggctaacatcatcgatatctggcgcagcaccgtcgatgccatgttcgagaactatcccttcccgcagaacaacggtaaccgtcagcatgtccgctggacggcactgactaaccgccacggcaacggtctgctggtggttccgcagcgaccaattaacttcagcgcctggcactatacccaggaaaacatccacgctgcccagcactgtaacgagctgcagcgcagtgatgacatcactctgaatctcgaccaccagctgcttggcctcggctccaactcctggggcagcgaggtgctggactcctggcgcgtctggttccgtgacttcagctacggctttacgttgctgccggtttctggcggagaagctaccgcgcaaagcctggcgtcgtatgagttcggcgcagggttcttttccacgaatttgcacagcgagaataagcaatgaggatcatcgataacttagaacagttccgccagatttatgcctctggcaagaagtggcaacgatgcgttgaagcgattgaaaatatcgacaacattcagcctggcgtcgcccactccatcggtgactcattgacttaccgcgtggagacagactccgcgaccgatgcgctatttaccgggcatcgacgctattttgaagtgcattactacctgcaagggcagcaaaaaattgaatatgcgccgaaagagacattacaggtagtggaatattatcgtgatgaaactgaccgtgaatatttaaaaggctgcggagaaaccgtagaggtccacgaagggcaaatcgttatttgcgatatccatgaagcgtatcggtttatctgcaataacgcggtcaaaaaagtggttctcaaagtcaccatcgaagatggttatttccataacaaataacaactacggcggcaaaaggagtttgccgccaccgctaccctactcattttcggagatgtgttatgtctgataccaaacgtaatacaatcggcaaattcggcttgctctcgctgacttttgccgccgtttacagctttaacaacgttatcaataataatattgagcttggactggcctcggcaccgatgtttttcctcgcaacaattttttattttattcccttctgtctgatcatcgcagaatttgtttcgttaaataaaaactcggaagccggtgtctacgcgtgggtaaaaagttcgctgggcggacgttgggcatttattactgcctatacctactggttcgtaaacctgttctttttcacctcgttgttgccgcgcgttattgcttatgcttcgtatgccttcctcggctacgaatatattatgacgccggttgccaccaccattatcagtatggtgctgttcgccttctccacctgggtttccaccaacggggcgaaaatgctggggccaatcacctccgtcacttcaacgctgatgctgctgttaacgctctcctacattttactggcaggtacggcactggttggcggcgtacagcctgccgatccgatcaccgttgacgcgatgatcccgaacttcaactgggcgttcctcggcgtgaccacctggatctttatggccgcaggtggcgcggagtccgtcgctgtgtacgttaacgacgtcaaaggcggttcgaaatcgttcgttaaagtgatcatcctcgccgggatttttatcggcgtactgtattccgtctcctcggtgctgattaacgtcttcgtcagcagcaaagagttgaaatttactggcggatcggtacaggtattccacggcatggcggcatattttggtctaccggaagcactgatgaatcgctttgtcggtctggtgtcctttaccgcgatgttcggttccctgctgatgtggacggcaacgccggtgaaaattttcttctccgaaattccggaaggcatctttggtaagaaaaccgtcgaactgaacgaaaacggcgttccggcgcgcgcagcgtggatccagttcctgatcgtcatcccgctgatgattatcccgatgctcggttccaataccgtgcaggatctgatgaataccattattaatatgaccgccgcagcgtccatgcttccgccgttattcatcatgctggcttacctgaatttacgtgccaaattagatcacctgccacgcgatttccgtatgggttcccgacgcaccggtattatcgttgtttcaatgctgattgcgatatttgccgtagggtttgtcgcttcgacattcccgactggcgcgaatattctgaccatcattttttataacgtcggcggtattgttatcttcctcggctttgcgtggtggaaatacagtaaatatataaagggattaacggctgaagagcgccatattgaagcgacgccagccagcaatgttgattaagcagaataataaaaaatgagcaggcattttccctcttcctggatggggagagggaaaatagtttctgcctttatatttttataattacaacgataaaaggctgtactttttctttagctcatggattaacacaatgaaattaatcactgcaccatgcagagcattacttgctctgccgttttgctacgccttttctgcggccgctgaagaagcacgtccggcagaacatgacgactcaaaaacccccgcaatgacctcgacatcttctccttcatttcgtttttacggcgaattaggggttggtggatatatggatttagagggtgagaataaacataaatacagcgacggcacctatattgaaggtggcctggagatgaagtacggctcctggttcggcctgatttacggcgaaggctggaccgtacaggccgaccacgacggtaatgcctgggtgcctgaccatagctggggtggcttcgaaggtgggattaaccgtttctatggcggttatcgtaccaatgatggcaccgaaatcatgctcagtctgcgtcaggattcctcgctggatgacctgcaatggtggggcgatttcacgcccgatctaggctacgtcattcccaatacccgcgatattatgactgcgctgaaggtacagaacttaagcggcaactttcgttataacgttaccgccacacctgccggacatcatgacgaaagcaaagcctggctacattttggcaagtacgatcgctacgacgacaaatatacctatccggcaatgatgaacggttacatccagtatgaccttacagaaggtatcacctggatgaatggtctggaaatcaccgacggcacaggccaactctatctcacgggcctgcttacccctaactttgccgctcgcgcctggcaccataccggacgcgccgacgggctggacgtaccgggaagtgaaagcgggatgatggtgagcgccatgtatgaagcgttaaagggcgtttatctctccaccgcttacacctacgccaaacatcgccctgaccacgctgacgatgaaaccacctctttcatgcagtttggtatctggtacgaatacggcggcggacgtttcgcaacggcttttgatagccgcttctacatgaaaaatgcctctcacgatcccagcgaccaactcttcctgatgcaatatttttactggtaataaggacagtaatctcatgaaaatcaaaaccattttaacgccagtagcctgtgctctgctgatgagcttttccgcccatgccgctaacgctgacaattataaaaacgtgattaaccgtactggcgcgccgcagtacatgaaggattacgattacgacgatcaccagcgttttaatccgtttttcgatctcggagcctggcatggtcatctgttgccagacggccctaacaccatgggcggttttccaggcgttgcgctgctgacggaagaatacatcaactttatggccagcaatttcgatcgcctgaccgtctggcaagacggcaagaaagtcgatttcacgctggaggcatacagtatacccggcgcgctggtgcaaaagttgatatcgaaagatgtacaggtcgaaatgattctgcgcttcgccacgccgcgcacatcactactggaaaccaaaatcaccagcgataaaccgctggatctggtgtgggatggtgaactgctggaaaaactggaagcgaaagaagggaaaccgctttccgataaaaccattgctggcgagtaccctgactatcagcgcaaaatcagcgccacccgtgatggcctgaaagtcatctttggcaaagtgcgcgccacctgggatctgctgacctccggtgaatcagaatatcaggtgcataaatccctgccagtgcagactgaaatcaacggcaatcgctttaccagtaaggcgcatatcaacggttcgacgacgctctataccacctactcccatctgctgaccgctcaggaagttagcaaagagcaaatgcagatccgcgatattctggcgcgtccggcgttttatctcaccgcctcgcagcaacgctgggaagagtatctgaagaaagggttaaccaatccggatgcgacgccggaacagacgcgcgtcgcggtgaaagccatcgaaacgctcaacggtaactggcgatcgccgggcggtgcggtgaaatataacaccgtcacgccgtcggtgaccgggcgctggttctccggcaatcagacctggccgtgggatacctggaagcaggcgtttgcgatggcgcatttcaatccggatatcgccaaagagaatatccgcgcggtcttctcctggcagatccagccaggcgacagcgtgcgtccgcaggatgtgggctttgtccccgacctgatagcgtggaaccttagcccggagcgtggcggcgatggcggcaactggaacgaacgtaacaccaaacccagccttgccgcctggtcggtgatggaagtgtacaacgtcacccaggataaaaactggctggcagagatgtacccgaaactggtggcctatcacgactggtggctacgtaaccgcgatcacaacggcaacggcgtaccggaatatggcgcaacccgcgataaagcccacaatactgagaatggcgagatgctgtttacagtgaaaaaaggcgccaaagaagagacgcagtctgggctgaacaactacgcccgtgtggtggagaaaggccagtacgacagtctggaaattccggcacaggttgcggcgtcgtgggaatcggggcgtgatgatgccgccgtctttgggtttatcgacaaggaacagttggataaatatgtcgctaacggcggcaaacgtagcgactggacggtgaaattcgccgagaaccgcagtcaggacggaacgttgctgggctactcgctattgcaggagtcggtggatcaggccagctatatgtacagcgataaccattatctggcggagatggcgacgattctcagtaagccggaagaggccaaacgctatcgtcagttagcacaacagctcgcggactacatcaacacttgtatgttcgacccgactacacagttctactatgacgtgcgtattgaagataaaccgctggcgaacggctgcgcgggcaaaccgattgtcgagcgcggtaaagggccggaaggctggtcaccgctgtttaacggtgcggcaacgcaggccaacgccgacgcggtggtgaaggtgatgctggatccgaaagaattcaacacctttgtcccgctggggacggcagcgttaaccaacccagcctttggcgcagatatctactggcgcgggcgcgtatgggtggatcagttctggtttggtctgaaagggatggagcgttacggttatcgcgatgacgccctgaaactggctgatacgttcttccggcacgccaaagggttaaccgccgatggcccgattcaggagaattacaacccgctcactggcgcgcagcaaggcgcaccaaatttctcctggagtgccgcgcatttgtatatgttgtataacgattttttccgtaagcagtaatttgcaacggctggcggatgcggcgtgaacgccttatccgccctacatgtgcaatcccccaggccggataagacgcgtcaagcgtcgcatccggcgttaccaccgggcgtattctttttgaatcccatcacaaaccccgcactccccttttcccttttctccggcgacggctaaattagaactcatccgaccacataacaattattttacatactggacaattttatgagctatccgtcgctgtttgccccgctggatttaggttttaccacgttaaaaaaccgcgtgttgatgggctcaatgcacaccgggctggaggaatacccggacggcgctgaacggctggcagcgttttatgccgaacgcgcccgtcacggcgtggcgttgattgtcagcggcggtatcgcaccagatttaacaggcgttggcatggaaggcggtgcaatgctcaatgacgccaaccagatcccacaccatcgcaccattaccgaagccgtacatcaggaaggcggcaaaatcgccctgcaaattttgcataccgggcgctacagctaccaaccgcatctggtcgcaccctccgcattgcaggcccccatcaaccgtttcgttcctcacgaactcacccatgaagagatcctgcaactgatcgacgatttcgcccactgcgcgcaattggcacgggaggcaggatacgacggtgtagaggtgatggggtccgaagggtatttgatcaacgaatttctgacgctgcgcaccaatcagcgtagtgaccagtggggcggcgattaccgcaaccggatgcggtttgccgtagaagtagtgggtgcggtgcgcgaacgtgtcggcaacgacttcattattatctaccgtttgtcgatgctcgacctggtcgaaggcggcggtacttttgccgaaacggtagagctggcgcaggccattgaagcggcgggcgcaacgattatcaacaccggcattggctggcatgaagcacgtattccgaccattgccacgcccgtgccgcgcggcgcatttagctgggtcacgcgcaaactgaaaggccacgtttcgctgccgctggtgaccaccaaccggattaacgatccgcaggttgccgacgacattctctcgcgcggtgatgcggacatggtatcgatggcgcgaccgtttctcgctgatgcggagctgctgtcaaaagcgcaatcgggacgagccgatgagatcaacacttgtattggctgcaaccaggcctgtctcgatcagatcttcgttggcaaagtcacctcgtgcctggtgaatcctcgcgcctgccatgaaaccaaaatgccaatccttccggccgtgcagaaaaaaaatctggcggtggtcggtgcgggacctgctgggctggcgtttgccattaacgcggcggcgcgtgggcatcaggtaacattgtttgatgcgcacagcgagatcggcgggcagtttaatatcgccaaacagatccccggcaaagaggagttttacgaaacgctgcgctattaccgccggatgatcgaagtgacgggtgtgacgctaaaactcaatcacacagtgacagcggatcagttacagtcgttcgatgaaacgatcctcgctagcgggatcgtaccgcgcattccgcctatcgacggaatcgatcatccgaaggtattgagttatctcgatgtactgcgcgacaaagcgccggtaggcaacaaagttgccatcatcggttgtggcgggattggttttgatacggcgatgtatttaagtcagccgggcgaatccaccagccagaacatcgccgaattctgtaatgaatgggggatcgacagtagcctgcaacaggctggtggcttaagcccgcagggaatgcagatcccgcgtagcccacggcagattgtgatgctccagcgcaaagccagcaaaccgggacaggggttaggcaaaaccaccggctggatccatcgcaccaccctgctctcacgcggcgtgaaaatgatcccaggcgtaagttaccagaagatcgacgatgacgggctgcatgtagtgatcaacggcgaaacgcaggtattagcagtggacaatgtggtgatctgcgcagggcaagagccaaaccgcgcattggcgcaaccgctgattgatagtgggaaaactgtgcatttaattggcggctgcgatgtagctatggagctggacgcacggcgggcaattgcccagggaacacggctggcgctggagatttaaatcgttgtttgaagcgccggatgcgacgcatccggcacgtcgcgttaatcaataaacaaggcgggagaaatgccgaatcgcgttgccagttttttagcgtgttccagcgttaatttcctcttcccgctcaaaacgcgtgacaccatcgatttactgccaatttccggaagatcggaaagggttaaaccatattgatccataagggtacgaatcacagctataccgccaggcatggcttgcgccatggcattaaattcagcaaattcgggcgctgattcttcccacgcggttattttggcacacaccagatccagcaaggggttttcaggatcgttgagcagcagatgatctaccagttccagcgcctgggtgtattgttcctcgttctgaatacccgccagaaaaggtgccacagcagttaacttttctcctgcttgcaagatgtcggcaatcgcaatcattttttccccttagtacgatgaacggcggtaaagaaatcgtattctttatgcgtcataacttcacgtatgtagcataaacgttgaacaacgctaaacaagagaatgtagaggatggtgacagggattttttgttttatggaagcgcgattccagaactgggcagacattgccggatgcgacgtttgccgcgtcttatccgacctgggggtaatgtgctgaacgtatgccggataaggcgtttacgccgcatccggcaggtaacccccaatcttaccgacgacgccccagcttcactgctttcagcaccacaaatttattattcgtggcgatggtggtgcagttgccgaaaattttcttcagtttatggaagtaatccaggtgacggttggcaacgatatacagctcgccgttgattttcaggcagcggcgggcatggtggaacatctcccaggcgacgttatcggtcagcgcatgttgctgatgaaacggcgggttgcagagcacagcattaaaacggaaaggctccacgccggagagcgcgttgttgatcataaactcgcagcgatccaacgcctcgggcatgttggtttcaacgttcaaacggctggaagcaaccgccatcggtgattcatcgacaaacaccactttcgcctgcgggtttttatcgagcaatgtcaggccaataacgccattaccgcaaccgagatcgacaatctcaccttcgagattctctggcagatgttgcataaagaagcgcgcgccgatatccagcccagtgcgggagaaaacattcgcatggttgtggatagtccagtcagtgccttccagcttccagctaacggtctgcggcgcatcggccaacggcggttcgttgaaggtgcagttaatcaggcgcgctttcttccatgccagcgtggtggtggtcggaccgagcactttttcgaacaattccagcgtggaagtgtgaatgtcacgggctttggcaccggcaataatgcgcgtatctggcgtgaccactttgcgcagcgcgcgcagttgttgttccagcaatgccagtgttttcggcactttgatcagcaccacccccggctgttgcgggtagtcggcggtgctgtcgaggaacttcacgctcgactcatcaatgccgttgagacgtaaattctcacgcgtcgccaactcgctgatgtatgagtcaccaatgctgtagggcttatgttccgccagcacacagcttaacgcaccaaaagcatcattcaggatcaacaccgggccgcggatttctgtgtcgtccaactgttgcagcaaatattcatccgccgcttcccacgcctgtagcgggttaacgtcatccgtcgccggaaaacgttgtagtgtcagtgaacggaaaccgttgtctaagtggctcatcggccctcctgaatgataaaatttcgacgttgcccctgaaaagggtgcgtgagtataccctttttctctttttcgtgggcggttatgagcaatcttacttatcttcagggttatcccgagcagctactttcccaggtgcgaacgctgattaacgaacagcgtctgggcgatgtgctggcaaaacgttatccgggaacacacgactacgccactgataaagccctctggcaatatactcaggatcttaaaaatcagtttctgcgcaatgccccgccgatcaataaagtgatgtatgacaacaagatccatgtgctgaaaaacgcgctcggcttacatactgccgtttcgcgtgtgcagggcggcaagctgaaagcaaaagcagagatccgcgtcgctaccgtgtttcgcaacgccccggaaccgtttttgcgcatgatcgtggtgcacgagctggcgcacctgaaggagaaagagcataacaaagcgttttacaagttgtgctgtcatatggaaccgcagtaccaccagcttgagttcgacacccggctgtggctaacgcagttgtcgcttaggcaggacaaaatctgaaaatgatgtcaggcgttattttttcctcctttagcgcctaaaatcgacctcctccctttcgttaaggataacgaccatgctgcgcgcatttgcccgccttcttctccgtatttgtttttctcgccggactcttaaaattggctgtttattgttgcttatagcaggagcaaccctttttattgccgatcgcgttatggtcaacgccagccaacaactgacctggagcgatgtcaacgccgttccggcgcgtaacgtgggtttattgctgggggcgaggccgggtaatcgctactttacccgacgtattgataccgcagcagagttgtaccacgccggaaaagtgaaatggctattggtgagcggcgataatggacgtaaaaattacgatgaagcgccaggaatgcagcaagccttgatcgctaaaggcgtaccggcaaaagccatcttctgcgactatgccggattctcaacgcttgattcggtggtgcgtgccaacaaggtgtttagtgaaaaccatatcaccattatctcgcaagaatttcataaccaacgcgccatctggctggcaaaacagtatggtatcgatgctatcggttttaacgcgccagacctcaatatgaagcacggtttatatactcaactgcgggaaaaacttgccagagtcagcgcggtgattgatgcgaaaatcctccatcgccagccgaaatatctcgggccgttggttatgattgggccgtttagtgagcatggctgtccggcgaaagaataatgcgtatctgcgcacgtcgaagataaaaaaggcgtgctacattgacgagagaatccctttatggagtatccacgcgttatgatacgtttcgctgtgattggtacgaactggatcactcgccagttcgtcgaggccgcccatgagagcggtaaatacaagttaaccgccgtttattcccgcagtcttgaacaggcccagcacttcgccaatgatttttctgtcgagcatctgtttacgtcgctggaagcgatggcagaaagcgatgccattgacgcggtgtatattgccagcccgaattccctgcacttttcccagacacaacttttccttagtcacaaaattcatgtgatttgcgagaaaccgctggcgtcgaatctggcggaagtggatgccgccattgcctgtgcgcgggaaaatcaggtggtgctgtttgaggcatttaaaacggcctacctgccgaactttcatctgttacgccaggcgctgccgaaagtcggcaaactgcgtaaagtctttttcaactattgccagtattcctcgcagtatcagcgttacctggacggagagaatcccaacaccttcaatccgacattctctaacggttcgattatggatatcggcttttactgcctggcgtcggcggtggcattattcggtgaaccgaaaagcgtgcaggcaaccgccagtttgctggcaagcggtgtggatgcccacggcgtggtggtgatggattacggtgatttcagcgttacgttgcagcactcaaaagtgagcgattctgtcctggcaagcgagattcagggcgaagcgggagcgctggtgattgaaaaactctctgaatgccagaaagtctgctttgtaccgcgtggcagccagatgcaggatctcacccagccacagcatattaataccatgctctacgaagcagagctgttcgctaccctggtggatgagcatctggtgaatcatccagggctggcggtcagtcgtatcaccgccaaactgctgactgagatccgccgccagactggggtgatttttccggcagataacgtaaaactataattgccaaagtaaaacagtgtaaaaggtatgtaacagaccattgactgactgaatggtctgtcatactttgttacctgcaaaggggagtaacttcattgtcggtcgatcgtcattacgatgtgtgaaaaaccacatccggtcaccgggcaacccgaaaggaatacgcagacgtattccttttttgttgtaagtgagaccttgccggaaggcgaggtctatgcataaaaagcagcggctgacgtcttccgacgttggccgtttttttatgtgtaaggaacttctatgaatactgtcggcacgccgttgctatggggcggattcgctgttgttgtcaccattatgctggctatcgacctgttgttgcaggggcgtcgtggggcacatgccatgaccatgaaacaggctgcggcctggtcgctggtctgggtgacgctgtcgttactgtttaacgccgctttctggtggtatctggtgcaaaccgaaggtcgcgccgttgccgatccacaggcactggcctttctcacgggttatctgattgagaaatcgctggcggtcgataacgtctttgtctggctgatgttgttcagctatttctctgttccggcggcattacaacgccgcgtgctggtgtatggcgtactcggggcgattgttctgcgtaccatcatgatcttcactggtagctggctgatttcacagttcgactggatcttgtatatcttcggtgccttcctgctgtttaccggcgtgaagatggcgctcgcccatgaagatgaatcaggcattggcgacaagccgctggtgcgctggctacgcggtcatttgcgcatgaccgacaccatcgacaacgagcatttctttgtgcgtaaaaatggtttgttgtatgccacgccgctgatgctggtgctgattctggtggagttgagcgacgtgattttcgccgtggatagtattccggctatcttcgccgtaaccactgacccgttcattgtgctgacctcaaacctgtttgcgatcctcggcctgcgtgcgatgtatttcctgctggcaggtgtggcagagcgtttctcgatgctcaaatatggtctggcggtgattctggtgtttatcggtatcaagatgctgattgtcgacttctaccatattccgatcgccgtctcgctgggcgtggtgtttggcattctggtgatgacgtttattatcaacgcctgggtgaattatcggcatgataagcagcgggtagaataatttttaatctgcctaagccgtgtactctgtcatcaacatgagcaccgttttctccctctccccaaaaggggcgaggggactgaccgagtacttttttgacgttgtcatcagtctggaagccgcacgttgggctttattttcatgtcaaacaaatgtaaccattaagttgcgaaatatgacttctctttaaaatccagcatatttcgcttcccgaagctgtaactttccttatactcgaccttgcaaacactttgttacatcctgaaagatgcgtcgacagaacgcaccagggatgtgcgacaacacaatgaaaggatcgaaaaatgactacgcaacattcaccggggctattccggcgtctggctcatggcagcctggtaaaacaaatcctggccggccttattctggggattcttctggcatggatctcaaaacccgcggcggaagctgttggtctgttaggtactttgttcgtcggcgcactgaaagccgttgcccccatcctggtgttgatgctggtaatggcatctattgctaaccaccagcacgggcagaaaaccaatatccgccctattttgttcctctatctgctgggcaccttctctgctgctctggccgcagtaatcttcagttttgccttcccttctaccctgcacttgtccagtagcgcgggtgatatttcgccgccgtcaggcattgtagaagtgatgcgcgggctggtaatgagcatggtttccaaccccattgacgcgctgctgaaaggtaactatatcgggatcctggtgtgggcaattggcctcggtttcgcactgcgtcacggtaacgaaaccaccaaaaacctggtcaacgatatgtcgaatgccgttacctttatggtgaaactggtgattcacttcgcaccgatcggtatttttggtctggtttcttctaccctggcaaccaccggtttctccacgctgtggggctacgcgcaactgctggtggtactggttggctgtatgctgctggtggcgctggtggttaacccactgctggtatggtggaaaattcgtcgtaacccgttcccgctggtgctgctgtgcctgcgcgaaagcggcgtgtatgccttcttcacccgcagctctgcggcgaacattccggtgaatatggcgctgtgtgaaaagctgaatctggatcgcgatacctattccgtttctattccgctgggagccaccatcaatatggcgggcgcagcaatcaccattaccgtgttgacgctggctgcggttaatacgctgggtattccggttgatctgcccacagcgctgctgttgagcgtagtggcttctctgtgtgcctgtggcgcatccggcgtggcgggggggtctctgttgctgatcccactggcctgtaatatgttcggtatttcgaacgatatcgccatgcaggtggttgctgtcggctttattatcggcgtattgcaggactcctgtgaaaccgcgctgaactcgtcaactgacgtgctgttcactgcggcagcttgccaggcggaagacgatcgtctggcaaatagcgccctgcgtaactaatacttagcccctttcgtctacggcggaaggggttttctccactttaaacggatcaattccccttctctgcatacgccagaaacgaatgatattcaggccattcatcagcagaaaactgccttcaatcatcgtgccgcctatcgaccccgcccagaagttgtgaatcacccagcaacacgttgaaaaccacattacgcagcgcatggtcagccctttacagcggaacagcgcccaggtactgacaatcgtgccgattaccggcaatagttcgacaggatgatggaacttcgcgaggccaattccgccagtcagcacaataaaaatcgccattacccataagctgcgcgtgcgtaaggtaatcaatgtacgaatggcattaaggatggcactggcaccggcaggataggtgcccagaagaaaaaaatgtacgccaataacggcgctatagaccgaaagttgctttttgaagcgacgttcgtcacgattgaaaaatgttgtgataccaatcagaaaggcgatgacacccacgccctgggccagccaatacgcggtcatgataaatccttagcaggtatggaaaagcaaacggcgcttcacattatgaaacgccgttttttattaacaactcatttcgactttatagcgttacgccgcttttgaagatcgccagttcgcggaagtcgttacgctcgttacaggtttgcttaccgttggcaaactcaacgatggtgtcgataaattcttccagcaactgcggcatcgctttaccgtggatcagctgacccgcgtcaaagtcgatccagtgttttttcttcgccgccagttcgctgttggtggcgattttcaccgtcggtacaaagccgccgtacggcgtgccgcgaccagtactgaacagcaccatatggcagcccgcacccgccagggcgctggtcgctacggcatcgttacccggcgcacttaacaagttcagccccggcgttttcagacgctcgccgtaacgcagcacgtcaaccacgacactggaacccgctttctgggtacagccaagcgatttatcttccagcgtggtgataccgcctgctttgttccccggtgatgggttttcgtagatcggctggtcatgggcaataaagtactgcttgaagtcattgaccatggtgaccagtttttcaaacgttgcttcgtcgcgacaatggtccatcagcaactgctctgcgccaaacatctccggcacttcggtcagtacggtagtaccgccgttagcaatcacgtagtcagagaaacgccccagcatcgggttagcagtaataccagaaagaccgtcagaaccaccgcactccagaccaaacttcagttcgctgagtttgcccggctcgcgtttatcgttgcgcatcacgctatacagctgatgcaaatgcgcgatcccggcctcgatttcatcatcctgctgttggcagatcatgaaatgaacgcgttcaggatcgatatcgcccaacgtttcacggaatgcggcaacctggttattttcgcaacccagaccaatcaccagcactgcgcccgcgttcgggtggcgcaccatgttttgcagcatggtgcgagtattgatgtgatcgtcgcccagttgtgagcagccgtaggtgtggctgaagaggaacacgccgtcggtaccttcagcgttgttggtctctttcaggaaacgattttggatctgccgcgcgatgccgttgacacagcccacggttggcaggatccacagctcattacgcaccccgacatcgccgttagcgcgacgatagatctgcacttcacgatctgccgcttgcgcaggcagatcctgaaaatcaggttgatagcgatactgatccagatcgctcagattcgtgcgcgtattgtgggcgtgaacatgttcccccgccgcaatatccgccaatgcataaccaatcggcaggccatatttaatgacgttggccccttttgcgatatccgttaacgcaaatttatgtccacgagcaacatcctggcgcagcgtaacagtctggttatcgacactgacttctgtgccttcagccaaatccgctaaagcaaccgcgacgttatccagcgcatggatcttgatgtattgcatatcaaccccagaccttagttcagttcaatggcgaagtagtcacgcgcattgttaaagcaaatatttttcaccatctcgcccagcaggttgatgtccgccggtgcttcgcccgcttccacccagcgaccgatcatctggcacagaatgcggcggaagtattcgtgacgggtgtatgacaggaagctacggctgtcagtcagcatgccgacaaagcggctcagcagaccgagctgcgccagttgggtcatctgacgttccataccgtctttctggtcgttaaaccaccagccggaaccgaactgcattttgcccggcataccttcgccctggaagttaccgatcatggtgcccagcacttcgttatcgcgcgggttcaggcagtagagaatggttttcggcagcaggttttcttcattctgcttgctcagcagcttagacagctcttccgccatcggacggtcgttgatggagtcaaagccgacatccggccccagcagtttaaactgacgcaggttgttattacgcagtgcgccaatgtggtactgctgtacccagccgcgacgtgcatattcggcaccaaggaacaccagcaccgcagttttgaactgtgccacttcgtgctcgctcagggtttcgcctgccagacggcgcgcgaggatactgtccagttccgcttcgttcgcttcagcaaacatcaccacatccagcgcgtggtcagacactttacagccgtgagcggcgaagtgatccaaacgtttagtcagggcagtttgcaggtcagcaaagcggcgaatgtcggtatcggaaacttcgcccagcttcgccatgtagtcgttaaaggtcgcctgttcaatgttaaaggctttgtccggacgccagctcggcagcactttaatggtgaaagagccgtctttggcgatctctgcgtgatgctccagagaatcgatcgggtcatcggtggtgccgaccattttcacgttcatctgctgcatgatgccgcgcgcggagaagttatcctgcgccagcagttcgttacattcgttccagatttcatcggcagttgacggagaaagcaatttgccagtgataccaaacggacgacgcagttcgaggtgcgtccagtggtataacgggttgccaatagtgtgcggaacagtcgccgcccaggcgtcaaatttttcacggtcagacgcatcaccggtgcacagacgctcggccacaccgttggtacgcatagcgcgccatttgtagtgatcgcccttcaaccagatgtcatacaggtttttaaaacgatagtcttccgcaatctgctgcggcggcaaatggcaatggtaatcgaaaatcggctggtcttttgcgtagtcgtgatacagacggcgggcaaattcagtatctaacaggaaatcttcagtcataaacggagtcattttcgtcttcctctcaacgagtgagctagcttgcttatggtgcgacgctgacaaagttatcacaccaatttccagagtccgaagatattttcgtgagttagatcaataaacgtagttaaaaaaattactctcaaagtggtaaatctcgctgcaggccgcgccagcactggcctcgccgtcgtcaggtaatgtccctacaaatattcgcacatttgtgatggctctcaccttttaaagttgtatgacaagttatctttctgccgtcgcaaatcataagtcgacggaatgcaaattgccgattcattcatttgttagatgaatcgggttaaccggtacggaagccgaattagcacgaaactttcatggcaacgttcggggcgtgtcggttttttttcggttacccggtcgtaactaacatcttcagcctctggcgggatgatggccgcgcttcctgcggatataacaaaacgatgaggttttacatgcgtaaaattaaagggttacgttggtatatgatcgcactggtgacgctcggcaccgtgcttggttacctgacgcgtaacactgtggcggcagctgcgccaactctgatggaagagttaaacatctccacccaacagtattcctatatcatcgcagcgtattctgctgcttatacggtcatgcaaccggtagcgggttatgtactggatgtgctgggtacgaaaatcggttatgcaatgtttgctgtactgtgggccgtgttctgtggtgcaactgcgctggcaggtagttggggtggcctggcggttgctcgtggtgcggtcggtgccgcggaagccgcgatgattccggcgggtctgaaagccagctccgaatggttcccggcgaaagagcgttccatcgcggtaggttactttaacgtaggttcttcgattggtgcgatgattgcgccgccgctggtggtatgggcaatcgtgatgcacagctggcagatggcatttatcatctccggtgcgttgagctttatctgggcgatggcatagctgattttctacaagcatccgcgcgaccagaaacatctgaccgatgaagaacgcgactacattattaatggtcaggaagcccagcaccaggttgacacagcgaagaaaatgtccgttggtcagatcctgcgtaaccgtcagttctggggtatcgcgctgccgcgattcctggcagaaccggcatggggtacttttaacgcgtggatcccgctgttcatgtttaaagtttacggctttaacctgaaagagatcgcgatgtttgcctggatgccgatgctgtttgctgacctcggttgtatcctcggtggttacctgccgccgctgttccagcgttggtttggtgtgaacctgatcgtttcccgtaagatggtcgtaacgctgggcgctgtgctgatgattggcccgggtatgatcggtctgttcaccaacccgtatgtcgcgattatgctgctgtgtatcggtggttttgctcaccaggcactgtctggcgcactgattacgctctcttctgacgtgttcggtcgtaacgaagtggcgacggcgaacggtttaaccgggatgtccgcatggctggcaagtacgctgtttgcactggtagtcggtgcactggctgacaccatcggcttcagcccgctgttcgcagttctggcagtgttcgacctgttaggtgcgctggttatctggaccgtgttgcagaacaaaccggcgattgaggtggcgcaggaatcacataacgatcccgcaccgcaacattaaggcttcgtgtaagttttagtttcccttcaaagccgccttctcaggcggctttttcatcactgcgagtagagctaaactcgcaaaagtggtataacaaatatagtctgccgtatcatgcctggagcgcatatggaaatcactgaaccacgccgtttgtatcaacaacttgccgctgacctgaaagagcgcatcgaacagggcgtctatctggtgggtgataaactgcctgccgaacgctttattgccgatgaaaaaaacgtcagccgcaccgtggttcgtgaagccatcatcatgctggaagttgaaggctatgtcgaagtgcgtaaaggttcaggtattcatgtggtttccaaccagccgcgccatcagcaggcggctgacaataatatggaattcgccaattacggtccgtttgagttgctccaggctcgccagctcatcgaaagtaatattgccgagttcgcggcaactcaggtcacaaaacaggacatcatgaaattgatggccattcaggagcaggcacgcggtgaacaatgcttccgtgattccgagtgggatttgcagttccatattcaggtagccctggcgacgcagaactccgccctggcggctatcgttgaaaaaatgtggacccagcgtagtcataacccgtactggaaaaaactgcacgaacacattgatgcccgtaccgtcgataactggtgtgatgaccacgatcaaatcctcaaggcgctgattcgcaaagatcctcatgctgctaagctggcaatgtggcagcacctggaaaacaccaagatcatgttatttaacgaaaccagcgacgatttcgagttcaatgccgaccgctatctgttcgccgaaaacccggtggtgcatctcgatacagccaccagcggcagtaaatgaaattcctgtccgacaggcgctacagtgcgcctgtttgtctcgtcggtaagcgaaaagtataaagtgtcagcctgtgtaaatcctctcgcctccctcccctgcattcagcaaaatcagactccacggacatgtaattttgataacgaacaacgttgacctttgttacaattagattcaatttgaatttatgcttttgaatgctttcttatctcacgatttaacagggaatagttcaggctgtgttgatgtatcaaacccgcagaacataccaagacagcaataacattgcggtagtgcatcatttaaaaccagcgtggcgttaaccgattcaccaggaataatgaatggaacttttgacccaattgctgcaagccctgtgggcgcaggattttgaaaccctggccaatccgtcgatgattggcatgttgtattttgtcttgtttgtcattttgttccttgaaaacggcttgcttccggcggcctttttaccgggcgacagtttactggtactggtcggcgtattgattgcgaaaggcgcgatgggctatccgcaaacgattctgctgctgaccgttgccgccagcctcggttgctgggtcagctatattcaggggcgatggctgggcaatacccgcaccgtacaaaactggctatctcatttacccgcgcattatcatcaacgcgcacaccatctttttcataaacacggtttatcggcgctgttaattggtcgctttattgcgtttgtcagaacactgctgccgacgattgccgggttatcagggctgaataacgcgcgctttcagttcttcaactggatgagtggtctgctgtgggtgttgatcctgacaactctgggttacatgctcggcaaaacgccggtatttttaaagtacgaggaccagctgatgtcatgcctgatgctgctcccggtggtgctgctggtgtttggcctggcaggttctctggtcgtgttatggaaaaagaaatatggaaatcgggggtaagggatgcaaatacctcgcatgtcacttcgccagctagcctggtccggcgctgttttacttctggtcagcacactattgctggcctggtccgcggttcgccagcaagagtctacgctggcgattcgtgccgttcatcaagggacaacgatgccagacggtttttcaatctggcatcaccttgacgctcacggcattcctttcaaaagtatcacccccaaaaacgacactctgttaattacctttgactccagcgaccagagcgccgccgcaaaagcggtcctcgacagaacattgccccatggctacatcattgcgcagcaggacaataacagtcaggctatgcagtggctgacccggttgcgggataactctcatcgcttcggataacttcctgttatccgaaacagatcactcactttggtgatttcaccgtaactgtctatgattaatgaggcggtggttaacacgaccgcttcgttgtctggacaatcgttcctttgtaataggtccgaatcacaatggaaggttcaagaatgaaataccgcatcgctttagctgtttctctctttgctcttagtgccggtagttatgccactaccctgtgtcaggaaaaggagcaaaatatccttaaggagatcagctatgccgaaaaacaccaaaaccagaatcgtattgacggtctgaataaagccctgagtgaagtccgggccaactgttcagatagccaactgcgtgccgatcatcagaagaaaatcgcaaagcagaaagatgaggtggcggaacgccagcaagatttagccgaggcgaagcaaaaaggcgatgcagataagattgccaaacgcgaacggaaactggcagaagcgcaggaagagctgaaaaagctgaaagcgcgcgactactaactcacaatagtcactacttactcacctggagaaaactatgtcgaaagaacacactacggaacatctgcgtgctgagttgaaatccctttccgatacgctggaagaggtgcttagctcatctggcgagaagtcaaaagaagagttgagtaagattcgtagcaaagcggagcaggcactgaaacagagccgttatcgcctgggtgaaaccggtgatgccattgccaaacaaacccgtgtcgcggcggcgcgtgccgatgagtatgtgcgtgaaaatccgtggacgggcgtgggcattggcgcagcaatcggtgtagtgctcggcgttctgctgtcgcgtcgttaattatggcggacactcatcacgcgcaagggcccggtaaaagcgttctgggcatcgggcagcgaattgtttccatcatggttgaaatggtggagacacgtctgcggctggcggtggtggagctggaagaggaaaaagcgaatctctttcaacttttactgatgctgggcctgacgatgcttttcgctgcatttggtcttatgagcctgatggtgctagttatctgggcggttgatccgcaatatcgcctgaatgcgatgattgccaccaccgtggtgttgctgctactggcactgattggcggcatctggacgttacgtaaatcgcgtaagtctacgttgctgcgccacacgcgccatgagctggcaaacgatcggcagctgctcgaggaggagtcccgtgagcagtaaagtcgaacgtgaacgacgtaaggcgcaactgcttagccagatccagcaacaacggctggatctttccgccactcgtcgtgaatggctggaggcaacaggcgcttacgatcgtcgctggaatatgctgttgagtctgcgctcctgggcgctggttggcagtagcgtgatggctatctggacgattcgccatcctaatatgctggtccgctgggccagacgcggttttggtgtatggagcgcctggcgtctggtgaaaacaaccctcaagcaacaacagcttcgcggttaacttcctctctggccggagaaattccggccttatccctcaaattttttgaaaatatttgacagttttccttgctaacaatcacgcttcgtcacgtttatgattctctccatcgacagcaacgacgctaatagcgcgcccttgcacaaaaaaacaatcagcagcctgagcggcgcagtggagagtatgatgaaaaaattagaagatgttggtgtactggtagcgcgtattttaatgccgattctgtttattacggcaggctggggaaaaattactggctacgcgggtacccaacaatatatggaagcaatgggcgtccccggctttatgctgccgctggtgattctgcttgagtttggtggtggtctggcaatcctgttcggtttcctgacacgtaccacagccctgtttactgcgggctttacgctgctgacggcatttttatttcacagcaactttgcagaaggcatgaactcgctgatgtttatgaaaaacctgactatttctggcggattcctgctgctggcaattaccggtccaggcgcattcagcatcgaccgcctgctgaataaaaagtggtaagcacgcgctatacttaacgataaaaaacgagggggaagctcctcgtttttgctattggaggatagaaaaatgggtcaactgattgacggcgtctggcatgacacctggtacgataccaaatccaccggcggtaaatttcaacgttcagcttccgcatttcgtaactggctcactgccgatggcgcgccaggccccactggcaaaggcggttttgccgcagagaaagatcgttatcatctctatgtttcactcgcctgcccgtgggcacaccgcacgctgatcatgcgtaagctcaaaggactggaaccgtttatttccgtttccgtagtgaacccgctgatgctggaaaacggctggacctttgatgacagttttccgggagcaaccggcgacacgctctatcaacatgaatttctgtatcagctttatctccacgccgatccacactacagcggacgagtgactgttcccgtgctgtgggacaaaaaaaaccacaccatcgtcagcaacgaatcagcagaaatcatacgcatgttcaataccgcgtttgatgcgctgggtgcgaaagctggagattactacccaccagccctgcaaccgaaaattgacgaacttaacggctggatttacgacaccgttaacaatggcgtgtataaagccggttttgccaccagccagcaagcctacgacgaggcggtggcgaaagtgtttgaatcgctggcgcgactggaacagattttaggtcagcaccgttacctgaccggcaaccagctaaccgaagccgatattcgcctgtggaccacgctggtgcgttttgatccagtgtatgtgacccacttcaagtgtgataagcaccgcatcagcgattacctgaatctgtatggcttcctgcgcgatatctaccagatgccgggaattgccgaaacagtcaatttcgatcacatccgtaatcattacttccgcagccataagaccatcaaccctacggggattatttcaattggtccgtggcaggatctcgatgaaccgcatggacgagatgttcgcttcggttaaaaaaaggcaccttacgaggtgcctctgataattagctaagtacgtgttgttcatgtcggatgcggcgcaaacgccttatcaaacctacaaaacatttatattcaatatgttgcaatgaccgcgcaggccagataagcgtagcgcatctggcaattttgcgcttgcccttatccttcacagcgccttattaattcatcgcgataatatttactgccatttcattcacgtctattcttaatttgctgctttaaaaacaagtgattgagcaaaattgaggcaaaaatggactggtatctgaaagtactaaaaaattatgtcggtttccgggggcgtgcgcggcgcaaagagtactggatgtttattatggtcaacatcatctttacgttcgtgctggggctactggataaaatgttaggctggcaacgtgccggtggcgaaggcatcctgacgacaatctacggtattctggtgtttttaccatggtgggcagttcagttccgccgcctgcacgacaccgaccgctcggcgtggtgggcactgctattcttaatcccgttcatcggctggcttattatcatcgtctttaactgccaggcgggtacgccaggcgaaaaccgctttggaccagatccgaaactggaacaagaataataattaagcaccttgtaaaaggtgcttaatcgattattttccgctaaaaagtttgggaatttcccgcagacacctggatttcgcctcccccatactgtcacgacgccaggccataataatatcgatctcgctggtcgattccgggctgacgacacgcaaccgcccttccgcaatatctttttcgaccatcggatacggcatcgtcgccacgccaagccccgccagtaatgcctgacgtttatcttcaatcgtgctcaccgttaagcgcggctgtttgtccagcaactgtacggtcaacaccgggcgctcacgagcggtatccgccaccgcaattccacgatatttcacgcgcgtcacttcagataacggttccggctcctgatgaatcgggtgatccggcgcggcaacatagacgttcattaaggtatagagtttgcgcgagttgatctccgacgaggaacgaaaatgcatatccggcgcgataacgatatccgcccgcccctgctccagccgttcccacgcccccgccagcacttcggtgatgattgccagttgggtattggcttttgccgccagtttgtcgattaacgggaaaaaggcaggtgtcggtaccagcgcctcggtcacaatggtgagatgcgtttcccaaccacgcgcgagggcttccgcatcggtagtcagtttatctgcggcttccagcaaaacgcgccctcgttccagcaacatcctcccgacattggtgaatttggtgcgatggcccgagcggtcaaacagcaccacatccagctcttcttccagtttttgcatggtgtagctaagtgcggaaggcacgcgtcccagttcatccgccgccgccgcaaaactgccccggcgatcgatcgcatccataacccgtagtgcttccagcgttaatgccctttctttggccatttcgttctcattcaggaaatttgaacataccgggcagaatatctggctaacaatgtagcgtccagccccttaccataaaaggaagtaaagagaggtcaagaattatgattactacccgaactgccaggcagtgtggacaagcagactacggatggttgcaggcccggtatactttttcctttggacactacttcgacccgaaattgttaggctatgcctccctgcgcgtgcttaaccaggaagtgctggccccaggtgccgcctttcagccgcgaacctatcccaaagtcgatattttaaatgtgattctggatggagaagctgagtatcgcgacagcgaaggcaatcatgttcaggccagcgccggtgaggtgttgctgctctctacccagccgggtgtcagctatagcgaacacaatctcagcaaagacaaaccgttaacgcgaatgcagctttggctggatgcctgcccgcagcgagagaatccgctgattcaaaagctggcgcttaatatgagcaagcagcaattaatcgcctcgccagaaggtgggatgggaagcctgcaattgcgccagcaagtgtggctgcaccatatcgtgctcgacaaaggcgaaagtgcgaatttccagttgcatgggccacgcgcgtatttgcaatcgattcacgggaaatttcatgcgcttacgcatcatgaagagaaagcggcgctaacctgcggtgatggggcgtttattcgtgacgaggctaacattacgctggttgccgattccccactgcgcgctttgctgatagatttgcctgtctagttgtttttacagggagatgatgatgagtaaaaaatcggccaaaaagcgccagccagtgaagcccgtggtggcgaaagaacctgctcgtaccgccaaaaattttggctatgaagagatgttgagcgaactggaagccatcgtcgcggatgctgaaacgcgtttagccgaggatgaagccaccgcgtaaagacaggttgccggatgcggcgtaaacgccttatccggcctacaaaacccaacaacatcaacaaattgtgcaattcgtaggccagataagacgcgccagcatcgcatccggcacaatacccaaaacctggcgtttatctggccttgctcgccataatctcgataatctgccgatccgtttgctgcatcgaatggcttgctaacgcacacaggttggcaatcgactgctcaacatcatgcgccacaatcccttcattaccggttacggcggtatcatccagcgccattaacaccgctttccacgcagccgaagcactggtcgaaaccttcatcgcgcagctgttcgatgcaccatcgcaaatcatgccactgacatcgccgatcatactgctgatcgccatcgagatggtttcataacgcccatccaccagccatgccatcccggcagcggcccccattgctgcggtcgttgcggcacacagcgcagacaaacgcggtaactggttatggatgtaaatcgcgctcaaatgcgaaagcatcagcgcacgcgccagccgttcatcatccgctccgaagtgttctgctaccaccaccacgggcattgttgcggtgatcccctggttacccgagccggagttactcattgccggaagcgtagcgccgcccatacgcgcatcggatgccgcgctggtacgaatcacaatggatgaagagagatctttcgccagcaaaccgcgcgcgcactgtttttccagcgtcgcaccaatatgcagcccccagttaccgctcaaaccttcctgcgataacgcacaatttaacttcgcagaatcgagaataaagcggatcgccgcaaacgggacttcattgacgaacttcaggatctcagccagcgtcgtcctggaaagcaccgtcagcggcgactcttgctcgccctctgtcacacacgcctgctgggtaaacaccacaccattgtgcgtctcaatatgcacaatgttggtatgcccgccgacgatggtgacacacgcccacttctcaccgttccagactttggcgcgtgagaagaggatttcatcgcaaggttcctggatcttaactgagactttccccgccgccagcagtgccttggcatcggaaattgcctgcgcagttgcgtctttcagcacttccagcccggcgttagcatttccacctaacgctcccagcgccgccgcaattggcagccccaccattcctgtaccgggaacggtgacacccagaccgttcttcatcagatttggagaaacccaggcttctacacgttcaaccggaccttccagttcagccgcagcaaccgccgccgccagcgccagtgaaatcggttcagtacaccccagcgccggttttacttcctcctgaacggcgaggatgtaacgctgccataacggatttaaagtcgaatcaaacatattaaaaaccttaaaatttcaggtaaatcaagaaaatgccaggaacggagaaacacaaagcaacaaaccagtgacgataatcaggtacagagacatccctttgtatttgtgcaatgccggtactttgtaaaccagccacgccgggatcaggcaccctaccatgccgaaaatcgggctacagatagaggtgaagctcaacaccggggcgttcagtacgatggcgctccaggccagcaaaatggcgaaaatcatgatgccgcgctgaacgagattttcgttaatcttctcagcaggtatcttgcgacgcaggatgttcattacgatcccttgcgttgcttcgcgaaagcctaaatagacgccaaagaatgccgtcattacagcaaagatattgagaatgacgctgactactttcacccacgctgcgccatcaccgctaataaactgtgcggcaatcgccagcgcggaaatattctgctcgtaggcttttaccgcttcgtcatgtcccatcgccagcgtgaacgacacggcgtagaaaaagacggtaacaaacaaaatgccaaacgcgatattcattgcccgcaatgctttatgccgcgccacttcaattgatttttcccgcgaacgataagagatcaccatcgggcttaacgtctggataaacagaatcgacgtcagggtaaacggcagcgtaataatggcgtttttcaccagcagccccagcggcggtagcgaaccgacgttatacagatgccacattcccaccatcgacacgcccagcgccgcgaccaccagcagcttggtcagcaccatgccggtcgaaattttgaataacaatttctcgccgcgtgaggagatcgccaccagaatgcaaatcagtaccagaccataaaagggactgtctgacagcaacccttccgtcacgccgaaggtatgcaggtaggaagcactatcgttggtgatggcggtggaatagacgaacatccaaatcaccagcattacgaaatagagtgcacctaacaggatgccccagtttttacctaaataaccgctgatgacgctcgggtaatctttacactccggtgattctgccagcgtattaataaacaaccgctgaaacagatacattgccgggtaaccaatcaccgatgagagcaaaaatacccacaatcccatcaaaccgacctgcaccgggagaaaaacaatccccgcgccaatcgccatcccgatactcataatcacccagccggtgtcagtactgtcgaatttgatcgcttctcgccactcgctctcactcattccagcacgacccgccggggtcgaagcgtctgcaatgacgcctttattcgatgcaatttccataatttctcgctcaatattttgtagggcttattatttttttccgagccgcatcaaggcgatatgcggtctacgtttttgcaggcgagttattagaataaagaaatgatacgcgcgaggtcagagaaaatcttcacaatcaagactttgaaataacggagatggataagaattttctactaaattaatcgcaagagaatattcattctctatttgcggcagatcacaaaaaaaaggtgcacatttgtgcacccaaggatgaaagctgacagcaatgtcagccgcagaccactttaatagccagtcctccgcgtgatgtttcgcggtatttatcgttcatatctttgccggtttcatacatcgtctcgatcactttatcgagtgaaacacgcggtgccgaggtgcggcgcatcgccatccgcgcggcgtttactgctttcacggcattaatggcattacgttcaatgcacgggatttgtacctgtccggcaaccggatcgcaggtcagcccaaggttatgctccatcgcgatttccgccgcattgcatacctgcgccggactgccgcccagtagttcagttaaccctgccgccgccattgaacaggccacgccaatctccccctgacagccgacttccgcgccagagatggaggcgttcattttatacagcgcgccaattgcccccgctgccagaaaatagcgggcaattgaccgctcgtttaccggacgacggaacttatcgtaataagccagcactgccggaataatgccgcacgcaccgttagtcggtgccgttaccacgcgcccgccagctgcgttttcttcactaaccgccagcgcgtacatgttgatccagtcgatgacattcatcggatcgttagagatgttatcgctggaaaccagttgacgacgcagcgctacggcacggcgcggcacattgagcggaccaggcagcacgccttcagtattcattccacgttcaataccgtcatgcatcacttgccagatacgggcaaaccctgcgtcaatttccgctttactgcgcagcgccagctcgttgtgcatcatcaggccagatatagacaggccgttgtaatcacacattttcagcagttcacctgctgagtggaaatcgtaaggtacgggtgtttcgacatcgtgcgacaggccgaagtgttcttcttcgacaataaacccgccgccgacagagtaataggttttgcttaatagctcttcctgtcccttccaggcagtgatccgcattccgttctcatggcgaggcaacatttcgggatggaagataatgttctttgctacaggaaaatcaacaatatgcgcgccagaagccaccggcaaccgcccgctgcgcgtcactaactctataaatgcagggatctcatcaatgacaacatcctgcggactgtttcctgccagtcccatgatgatggcgacatccgtggcatggcctttgcccgtcagtgacaacgacccgtacagatcgaccacaatatggctcgtcgcggttaataagccgctactttccagccgatcaataaaactttttccggcattcattggccccactgtatgcgaactggagggaccaatcccaattttgaaaatatcgaatgcactaatcatatccacaccctcggattgccgttcagtgaagtggagcggaacgacctagcgaccgtcccgctcacgaggccttacgcactacgtactgcgatggcttcaatttccagcttcacatctttcggcaaacgcgcgacctgcacacagctccgggtcgggtaggtcgcctgatgttcatcgaagaactgcttatagacttcattgatggtggcaaaatcattcagatcggtgatgaacacggtcatcttgatgatatcgcccacactcagcccggcagcaaccacgatcgctttgacgttttcgaggcttaaacgcgcctgatcttgcacatcagccgggatctcaccggtctgtgggcaaaccggaatttgcccggaggtgaagaccatgctgcctaaatcaacgccctgaacataagggccgattgcgcctggggcacgttgcgtttcgataatctttttcatacatcctccggcgtcagagcgcctgggtaaaggtacgtgaaataacatcctgttgctgttcacgggtcagtgcgttgaagcgcacggcgtagccagagacacggattgtcaggttaggatatttttccgggtgctcaatggcatccagcagcatttcccgattcattacgttgacgttgaggtgttgaccgccttcgacatccgcttcgtggtggaaatacccatccagcaggccgacaaggttggttttacgtactggatcttctttgcccagcgccgcagggacgatggagaaggtgtacgagatcccatctttggcgtaggtgaacggcagtttcgccaccgacgtcaatgaggccacggcgcctttgcgatcacgaccgtgcatcgggttagcgcccggcgcgaacggtgttccggcgcggcgaccgtccggcgtgttcccggttttctgaccgtacaccacgttagaggtgatagtcagaatcgattgggtcggcacagcattgcgataggttggcaaagctttaattttcttcataaagcgttcaaccagatcgcaggcaatgctgtctacgcgctcgtcgttgttgccatactgcggatattcgccgtcaatctcgaaatccaccgccaggccgttttcatcacggattggtttcacacgagcatatttgatggcagacagggagtccgttgccaccgacaggcccgcgatgccgcacgccatggtgcgatagacatcacgatcatgtagcgccatcagcgaagcttcgtagctgtacttgtcgtgcatgtagtgaatgatattcagcgcgctgatgtactgtaccgccagccagtccatgaagtggtcgaggctatccatcactttgtcgtagtccagcacgtcatccatcaacggagccgttttcgggccaacctgaatcttcagcttctcgtccattccgccgttgattgcgtacagtagcgttttcgccaggttagcgcgtgctccaaagaactgcatttgcttaccaatcaccattgggctgacgcaacaggcaatcgcgtaatcgtcgctattgaagtcagtacgcatcagatcgtcgttttcatactgcaaagaggatgtgacgatagacacctgcgcggcatattttttgaaggcaatcggcaaggcttccgaccacagaatagtcaggttaggttccggtgcaggccccatagtgtgcagggtgtgcaaatagcggaaggagtttttggtcaccagggttcgaccgtccagccccatcccgccgatcacttccgtcgcccagatcgggtcgccggagaacagcgaatcaaattccggcgtacgcaagaagcgcaccatacggatcttcatgatgaagtggtcgatcagttcctgtgcctgctgctcattgagtacgcctgctttaaagtcgcgctcaatgtagatatcgaggaacgatgccgtgcgccccagcgacatcgcgccgccattttgcgatttcactgccgccaggtaagcgaagtagagccactgcaccgcttcctgtgcattctgcgccggacgggagatgtcaaaaccgtatttcgccgccatttcctgaatctgcaacagcgcacgacgatgttccgccagctcctcacgcagacggatcgtagcttcgagatcttcgcctttttccagacgggactggagatcggcaaactgcagttcgcgttcacgtaccagataactgatgccgtaaagcgccacgcggcggtagtcaccgatgatacgcccacgaccataaccatctggtaaaccggtcagtacaccagatttacggcagcgcagcatatccggtgagtaaacatcaaatacgccctggttatgggttttacgcagatcggtaaagatgtattcaaattcgctatccatttcacgaccatacgcggggaatgaacttctaatcatattaatgccgccgaacggatgcagcgcacgctttaatggcgcatccgtttgcagacccactattttttccagcggctggtcaatatatccttcatcatgagcggtaattgtggtggcaatattggtatcgaaatccaatggcgcgtgagtcgcattttcgatacggatgccttccatgactttttcccacaattccgtggtggcaggcgtcgcttcggcgagaaaagattcatcgccttcataaggtgtatagttatgttgaataaaatcgcggacattaatttcgtttttccagtccgtacctttaaagccaagccatgcgtcggcgtacagcttatcgctggtatcaatatctaccttcatgaaaaataatctctctacaatacttcaactaaattatgcaaattctgcgggcgcgttcactttgcctaaatgaatggcatccaaagcaatcattttttcttcgttagtcggaattacggcgcaaatgacacgcgcattttcactggaaacaattcgctctccaaaagagttagagcgattattcatttctgtatcaatttctacgcctaatacagctaaatgttccatgaccagacgacgaattaaacttgaattctctcctattccgccggtgaatataattccatccaggcgatgtaatgaagcagcgtgtccggcaatatgacgggcaattcggtgaacaaaggttttaattgccagttgcgcgcgttcgtgaccttcatgccaggctttttccagaacacgtaaatccgaagaaaggccggaaatacctaataatcccgactctttattcactacgcgttccaggtcccccaggctctggttggtttggctggcgacccaggacatcgccccgaagtcgacatcaccactgcgggtacccatcatcaagccttccagcggcgtcattcccatggaagtgtcaacactctgaccgttgcgaaccgcgcagattgacgcgccattgccaagatgcgccacaaccaggccggagtcatcttccgccagattcagcagagaatgcgcgcgctgggaaacatagcggtgcgacgtgccgtggaaaccataacggcgtacacctaactcttcataatatttccacggcaggccgtataaataagcttccggagccatcgtctggtggaaactggtatcaaataccgccacctgagttacgcccgggaataattgctgcgccgattcaataccacttaaattggcgtaattatgcaggggtgccagtggagaaacgcgacggatattatcaatgacttcatcggtaataatggcggactcggtaaaaatactgccgccgtgagcgatgcggtggccaattaagaccacactgtcatttaaattccgtttttccagttcaaatgcaattgccttcaatgcaccttcgtagctgtggtgagccagcggtgctggctctcccccatttacggataagaatgcatttttcgagttaataccgtcggcaatacctgacattaatacttcacagtcgctggcattgagtacggaaaacttaatcgaagacgaaccacagttaataaccaaaacaaccggaaattcattcatctcttttctcatcctgagttacggattaaaacagtttgtatacgatgttcaggatggtcagcagaccaatcacggtaacaaacacgttatccagacgaccacggtatttcgccagagacggcgctttacggatggcatacatcggcaacaggcacagcagtgatgcaataatcggtgcgcccatggcttcaatcaggtcgaggatgttcgggttggcgtaggcaacaacccaggtggagcccataatgaaaatcatgctgatagtattcagtttacccagcgacactttggttttgtcacctttataaccgaacttcagaatcaaaccattcagcccttccagcgtccccagatagtgaccgaagaaagatttgaaaatagccacgagtgcgatgatggaagcggcatattccagtgtaatcgcaaacgttgttttggtaccggtcatggacgcaaagtggttagccagataagaaagcactggaatattctgcgctttcgcttcagccatattcgccggagacagcgtaaacaggcagctaaaggcaaagaacatcaccactgcaaccatcagcatactggcgcgagagatgatttgtgaacatttacgctcggtgaagtcgcgaccaaaatctttctcgtactcttcacgtttagaaaccacgaaggaagagacgattggcgagaagttaaaggagaaaaccatgatggaaatccccagccagacggtgatcaggataccgtcatgaccagttaacgacagcgaaccgaggtcaacctggtcgataactgcagagttccagtaagggatcagcgaaagagaaatcagcaccaggctggcgataaacggccataccagatagctcatcactttaaccatcagatccttaccaaaccagatgacgaaagccatcagcagcaacaggaacagcgccacaaagccgcgattcagcggtgcaaagccgagctggttttcccagaacgtcataaaggtattggtaatagtaacgccataaatccacaacagtgggcaaatcgcgaagaagtacaggaacgtgataaccacgccgccagttttaccaaaatgctcttccaccgtttccgtaatgttgccggaagggttagagccagaaagacacagacgcgccagtgcccggtggcaataaaacgcgatggggtatgctaataccaacatcagaagaatcgggatcagtccgccaaaacctgcgcggatagggaagaacagcaccccggcgccgattgccgtaccaaacaagcctaacgtccatgtggtatctgatttacgccaggacgattgttttgtctggctggatacaatgctatctgaagtactcatatcctatcctcaacgaattaattaagcgtcaacgaaaccggtgatttgagagacgcgagaaagatcgatattgccgccggaaataatactgacggtttttctgttttgaatatattggtctaatttaccgcttaataatgcagcacatgccagagcgcctgcgccttcggtgacgactttattgcgctgaattaaggcaatcatactgtttctgatttcgtcttcgctgaccagcacgatgtcatcgactaattcacgaacgatttcgtaagttaaattacccgggcgggagacatcacaaccatccgccagggtgccggtagttcggtgcgtagttatttctccggagtggaaagaagccgccatgccgtgaacgttttcagactgtacgccaataacacggatggtcgggttgatagatttaattgccaccgcaataccagcaattaaaccgccgccgccaattggcacaatcacgttatcgacatcatagagatcttccataatttccagaccaatcgttccctggccagcaatcactttcggatcatcgtaaggtgggataaaaatacggccttccatttcgacaatttcgctcactttagcaatagtgtcgttgaagttatcaccatgcaacacgacttctgcggagtagtcgcacgttgccgcgactttggatttcggcgcaccttttggcatcaccactttaccgtcaatacccagcatcgcacaggagagcgaaaccccttgcgcatggttgcccgcagagcaggccactacacctttacgtttttccgcatcagtcagtgaacttaatttattaaatgcgccacgaattttaaatgaaccggtacgctgcatgttttcgaatttgaggaatatttcacctttgcaacgttcactaaaatagttggagcgaggcatacctgttttataaattcgcccagccagtcgttgttttgcttcaatgatgtcatcaatagcaaccgggagatcgtatgtaatatgcattataaaacctcttagcctgaattaaatatgtaggtaaccgtaaccgacacctgcaaaacagacaggtggattatttatgtttaaattaaaacaaataactaatcaacttcaattaattgccttcgtctacacccattataagatgaatactctttggctaattccaccaaaaccgatgctgcttttttaatacgataatttttcgaccataccgcggcatattgtgccacaggtaatgtttcttcaaccggaatagtaataaattgattagaaccaaaaggtgatgtcatatcacaaggaattacagttaagaaatcagcattgagaacaagattataaattgtcacgactgagtcggttttaacgatgttttcaatactgatgccatttctttgtaacgtagtaagtagttcgctgtagtaccccatattggtttgtggcaacacccactgttcgttcttcaacgactccagcgtggtggtgccggtgcatgttcgggacttactggctaccagcacaaactcggactcgaacagcggctcaacatgtaaatcctgaagcttcatttctgcgcttaacgtaccaatcgcaaaatccagtcggccgtcgcggattgccggtaagaacgaagacagttgcgcttcatacatagaaacctgcgctttcgggaacacctctttgaacttgttgatcatccctgacataaaagtaaaaccaatcaatgaaggaaaaccaaatgagacttccaccaccgcctcagaagacataccgcttatctcattaaccatatttttcatttcacgggtaatggattcggaacgggagagtaacaattgaccggcaggtgttaatgttacaccggtatttttccgcaccactaactccacaccaaaataatcttcaatatcgttaatgattttactgacggccggttgagttaaccctaactcttttgcagccgagccgatagaaccacttctaataacttcctgaaagactaccaggtgctgcgttttcggaagaagaatagtgctcataacgacctacgttaattacctcattgacggtatgaagtgtatcaaaatgaaatgaacaggatatgtgcgaccactcacaaattaactttcaatactttccatggcatcgttaccaaaattaaataccattaagtatcaacaagttaaagcatgaaaatcagcataaaccctgatttttgtcaaaaaaaatgacggggataaccatattttatggcgataacatcattctttatgtggttaatacaaaaaaggggctgagactatatttcaagcaattaccggataattaccaggcaaaatttgagttaaatttaatgagtaagttctcaaattttattataaacaaaccattttcagcgataaataatgcggcacgtcacattttttcacgctatttgttggagaacaaacatttattttatcaatattttaaaatttcgaatacaggtattgatcatctcgaacaattgattaacgtcaactttttctcttctgacaggacgtcattttgtgaatgcaatcgttttccataaattcttctcccctcataggcaacgaatagcattttgtgttgaggatcacaaaacgaataattgctggtcgccgcgataaggtcagacgaagtcaacaaggaggattttcgctgtgctttacatcagcgtaggccatagaatgttgcttcgttgactgtaatgccgggtaaatgagcattttttgatagtgcgaaagaaccctgcgaggaaaataagcatctattattgtttgtcatgatgacaaggctggcatcaatgaaaggcttctcaattgcacatatttttcacccttcaatgcacgcagtggttaacaatcacaatagaaatattgattattggacggtaaaaatttaggttataacgcccaaatgattcaacgatcggacaatacctgcgaacttacaattaatgagagaaatatatgtataattacgaccttttaaatgcaatatagacttaataacttcttacaaagtctgttattaataccgtagatattcatcttaccctgggcaccaaaagcaaaaacccgccgaagcgggtttttacgtaaatcaggtgaaactgaccgataagccgggttctgtcgtggacagtcattcatctaggccagcaatcgctcactggctcaagcagcctacccgggttcagtacgggccgtaccttatgaacccctatttggccttgctccgggtggagtttaccgtgccacggactgttaccagccgcgcggtgcgctcttaccgcaccctttcacccttacctgatcccgcttacgcgggccatcggcggtttgctctctgttgcactggtcgtgggtttcccccccaggcgttacctggcaccctgccctatggagcccggactttcctcccctccgcccgtctcccccgaagaggacgacgacgaagcggcgactgtctggtcagcttcggcgcgcagtatagagggtttgcgcgcccttgtcaccccgcgttgcgcattccaatcgccagtgtcgcggcgatattacgtgaagcacggcagatattgtcataagctccgcggagtgcttcgtctaacgtaccaatgctggtcagtacgctgaagaccgcatcaatgccatgctgatgtacaacgccaacatcattggtcaggctacccgcaatgccaatcaccggtttatggtacttcttcgccacgtttgcgacaccaatcggtaccttgccgtgaatactctggctatcaatacgcccttcaccagtgatcaccagcgtacaatcgtgaatatgttcctccagattcagcgccgtagtgacgatttcaataccacttttcagttctgcaccaagaaacgccatcagcgccgcgcccataccgcccgcagctcctgcgccgggggcatctttcacatcaacatgcagcgcttttttaataacatcggcatagtgagagaggttattgtccagctcgacaatcatcgcctcactggctcccttttgtgggccaaagatgcgcgaagcaccactgtcgccgactaacgggttggtgacatcacaagcgacgcggatgacacaatcttttaagcgcggatcgagaccggaaatatcaatatcattcagagtattaagactaccgccgccaaaaccaatttcattgccgttggcatcgcataatttcgcccccagcgcctgtaccatgcctgcgccgccgtcgttggtggcgctgccgccaatgccgataataatgtttgtcgcaccgctctccagcgcctgcaggattaactcaccagtaccgcgtgaagtggtcacgagtggatcgcgtttttccgcaggtaccagttccagcccactggccgccgccatttcgataaacgcggttttgccatcgccggagatcccccaactggcattcactttctcgcccagcggccctgtaacccaggcgtgacgttcagccccctgggtggctgcaatcatcgcttccaccgttccttcaccaccgtcggcaaccggaacagaaacatactgtgcatcaggaaaaatttcccgaaatcctttttctatcgcctgcgcaacctcgctggcagataaactttctttataagagtctggggcgattacgattttcatacctatgcctgttaccacatgacgccggagggcgtttctcttattcggcctggattccaggcccggattgcaatacgccatccgggcacgacgtcattagcgagtaacttcgactttcgccagtttttcgtagtagcacgccagggcgctatgatccgccgttcctaaaccatctgcacgcagtgcctgcatcatctccataaccgcagctgtgagcggcagttgcgcgccgacgccgtgagaagtatccagcgcattcgccagatccttaatatgcagatcaatacggaagcccggtttgaagttgcggtccatcaccatcggcgctttggcatccagcacggtactgcccgccagcccaccgcgaattgcctgatacaccagatccgggttaacgcccgctttggttgccagcgttaacgcttctgacatcgcagcaatattcagcgccacaatgacctgatttgccagtttggtgacgttacctgcaccgatttccccggtatgcaccacggaacccgccatcgctttcatcaaatcatagtatttgtcgaaaatagccttgtcgccgcccaccatcactgacagcgtaccgtcgatggctttcggttcaccgccgctcaccggggcgtccagcatatcaatgcctttcgctttcagcgcttcgctgatttcacggcttaccagcggtgcgatagaactcatatcgatcaataccgtacctggcttcgcgccttcaataatgccattctcacccagcgccacctctttcacatgaggggagtttggcagcatggttatgatgacgtcgcactgttcagcgatcgctttagccgtagaggctgtttctgcacctgcagcaatcacgtcagcaatagctgacgggttacggtcagcaaccaccagcgagtaacctgctttcagaaggtttttactcattggtttacccataatccccaggccaataaaaccaactttcatagtcatatcaatcatctctcttgttgcggtggtggttattttttaaaggtatcagccagtttctgagtggcagagcggaagatgccgagatcgctgccgacagccacaaacgtcgcaccccattccagataacgacgcgcatcagcctcgactggtgcgaggatgccgctgggtttgccgtgcgcgctggcacggttaaaaatgtgctgaattgctttttgtacatccgggtgcgaggcattgccgagatggcctaatgccgcagccagatcgctggggccgacgaagatgccgtctacaccttcggtagcggcaatagcatcgacgttatctacgccctgctgactttctatctggaccagaatagtgatgttcttgttcgactgagcgaaataatccgccacggtgccaaacatattggcgcggtgagaaacggagacgccgcgaatgccttccggtgggtaacgagttgatgccaccgcctgctctgcttcctcttttgtttctacaaaaggaatcaggaagttatagaaaccgatatccagaagacgcttaataattaccgggttggtcggcactcgcactactggcgcgctggcgctgcctttcagggccattaactgcggaataaacgtggagatatcgtttggcgcatgttcaccatccagcaccagccagtcaaacccagccaaaccaagaacttcagtgctaatcgggttagagagagctgaccagcaaccaatttgtacctgtttcgcagccagtgcggctttgaatttattcgggaaaacatcgttattcatcgcttatacctttgcttatttctgcaattccatacgtttaatgtcgccgactacgaagaggtagcagaccatcgccatcagcgctgaacatcccacaaaaaccagtgctgcattgaaggagtgcagttcacttaccaggtagccaatcaccagtggagtgacaatggaggcaacattgccaaagacgttaaagacgccgccgcagaggccaacaatctctttcggcgcggtgtcagaaatcactggccagcccagcgcaccaaatcctttgccaaagaaagccagcgccatcagcatgaccaccagcgtggtgttgttggtgtagttacataagatgatggtggaagccagcaacattcccagcacaattggtagcttacgtgccagggtcagggacaaaccgcgtttgatcagataatccgagaagacacctcccagcacgccgcccgcaaagccacacagtgccggaatcgaggcgaccagacccactttcagaatcgacatgcctttttcctgcaccagataaattgggaaccaggtgaggaagaaccaggtgatggtgttgataaaatattgtccgaaaaatacgcccagcatcatgcggttagagagcaattgcttgatgtaatgcagtttgggtccgcttgctgccgcactgcccggctttttgtggtccatatcgaccaccgcgccattttccgagataaacttcagctcttccgcagacatacgtgggtgatctgtcgggttatgaatcaacttgatccacagcgccgtcagcacaaaaccaatcacccccataacggtaaagacgtgctcccagccccaggcgaaagtcagccagccaagcagcggcgaaaagagcgccaacgagaaatattgcgccgagttaaagatggcggaggcagtaccacgttctttcgtcgggaaccaggcggcgacaatacgggcgttcgccgggaatgatggcgcttccgagaaccccagcataaagcgcataaagaacatggagatcccagcccaggccaggccaggccaggccaggccagcggaaacatatcgacaaagccttgcaggaaggtgaacagcgaccagaaaaagaggctgtaagtgtaaactttcttcgagccaaacttatcaagcagccagccgccgggaatttgcatcagcaagtaggcccagccaaaagcagagaagatgtaacccatcgaaaccgcacttaactgcaactcttttgccacttcggtaccagcaatagacagcgttgcacgatcggcgtagttaacggcggtaacaataaaaataatcagtaatattaaatagcgggtatgcacgcctttctttttttcgtcaacggtgtccagcatcattttatttacctcgggtacttatgctgatttttattattatggggaaggtgttatttatgagtttcatttatgccgttacgacaatgaactcgggaattagtataagcagcgcgagaataataatcattgtgcaaatgctaatttaattaatactatttaaatattattttgagcatatgcacataaggttgcgcgctaaagcacagatttgcgctttaccttgccgggaggtactgcaatccctgaaatgattgacattgatcacatttctgcatttaaactcctgacattcttatttcacccaatgaagttatttatttttaaatgagaccaggtcctcattttaatagtccctggctggagaatattgcacaatggccaacatcaaaatcagacaagaaacgccaactgcgttttatataaaagttcacgacacagataatgtggcaattattgttaatgataatggcctgaaagcaggaacgcgttttccggatgggctggaattaattgaacatattccccaggggcataaagtcgcattgctggacattccggctaatggtgaaattattcgttatggcgaggtgattggttacgccgtgcgcgcaatcccacgcggaagctggatcgacgaatcaatggttgtactaccggaagcgccgccgttacatacgctgccactggcaaccaaagtcccggaacccttaccgccgctggaaggatacacctttgagggctatcgcaatgccgatggcagcgtgggcaccaaaaacctgctcggcatcaccaccagcgtccactgtgtggcaggcgtggtggactacgtagtaaaaatcattgaacgcgatctgctaccgaaatacccgaacgtcgatggcgtggtggggctgaatcatttgtacggttgtggcgtggcgattaacgcacccgcggcagttgtacctattcgtaccattcacaatatttcgctgaaccctaactttggcggcgaagtaatggtgattggtctgggttgtgaaaagttgcagcctgaacgcctactgactggaacggatgatgtgcaagctattccagtagaaagcgccagcattgtcagtttgcaggatgaaaagcatgtcggttttcagtccatggtcgaggatattttgcaggtcgccgaatgccatctacaaaaactgaatcaacgtcagcgagaaacctgtccggcttcagaactggttgtcggcatgcagtgcggtggcagcgatgcgttttctggcgtaacggcaaacccggcggttgggtatgcgtctgatctattggtgcgctgcggcgcaacggtgatgttttcagaagtcacagaagtgcgtgacgcgatacatttgctgacaccacgcgctgtgaacgaagaggtcggcaaacggctgctggaggagatggagtggtacgataactatctcaatatgggaaaaaccgatcgcagcgccaacccttcgccggggaacaagaaaggcggtctggcaaatgtggtggagaaggcactcggctccattgctaaatcgggtaaaagtgcaattgttgaagtgctgtcgcccggccaacgcccgactaaacgcggattaatttacgccgcgacgccagccagcgattttgtctgtggcacgcaacaggtggcttcgggtatcaccgtgcaagtgtttacgaccggtcgtggtacgccgtacggcctgatggcggtacccgtcattaaaatggcgacccgcaccgagctggcgaaccgctggtttgatttaatggatattaacgcgggcactatcgctaccggcgaagaaaccattgaagaagtgggctggaagttgtttcactttattctcgacgtcgccagcgggaagaagaaaactttctcggatcaatggggactgcataaccagctggcggtgtttaacccggcaccggtgacctgatttcttttggaacgtccctcgcaaaacatggccttagtgccatgtttttattgtttaaagtccacacatccattaataatgcatttgcattaccttagttcaagcttataatttgagcagaaaacaggctgtaaaaggacagtaaataatgcccgctaatgctcgctctaacgctgtactgaccactgaatcaaaggtcactatacgcggacaaacaactatccccgcgccagtgcgtgaggccttaaaactgaagccaggcctggacagcattcattacgaaattctgcctggtgggcaagtatttatgtgccgactgggagatgaacaggaggatcatactatgaatgcatttttgcgttttctggatgcagatatccagaacaacccgcaaaaaactcgtccattcgacattcaacaaggaaagaaacttgtcgctggcatggacgtcaacattgacgatgagattggcgacgacgaataatggattttccacaaagggttaatggttgggcgctatatgctcatccctgttttcaggaaacctacgatgctttagttgccgaagtcgaggcattaaagggaaaagatcctgaaaattatcagagaaaagctgccacaaagttattggcggtggtccataaagtgattgaggagcatatcacggtcaatccatcatcaccggcattccgtcatggcaagtcgttaggctctgggaaaaataaagactggtcacgggtaaaatttggcgctggtcgctatcgtctcttctttcgttacagtgaaaaagagaaagtcatcattctgggatggatgaacgatgaaaacacgctgcgcacctacggtaaaaaaacagatgcctataccgtattcagtaaaatgttaaaaagaggacatcctcctgccgactgggaaaacctcacccaagagacagaagaaaaccattgatggtgttcacaatgcccgccgaacgcattggtgttgaccagcgggcatcctttctcattccccgaccagaatcacttcaaccccagcctttctcagtccttccagactatccgcaggaatgccttcatcaacaatgatcatgtcgatacgttgagtatcaatgatcttatgtaaactagaacgattgaacttactggaatcggtgaccacgatgatccgttccgcaacttcgcacatccgacggtttaaacgggcttcatcttcattatgcgtgctgacgccgcgctccagatcgatcgcatctacaccaagaaacagcatatcgaagtggtaattttgcagcgattgctcagcctgatcaccgtaaaaagattgcgactgacggcgcaaatgccccccggtcatcagcagctcaacgccttccgcttccagcaacgcattagccacgttcataccgttggtcatcgcaattacgtcggtgtgcttgcgcatcagacgagcaatctcaaaagtggtggtcccggagtcgaggatcacccgatgaccaggctgaatcaactcaacggcagctttcgcaacgctgcgtttcatcgcggtgttcagcgcgcttttatcttccactgatggctcgactgacggcgttgtgctatcgcagatcaacgcgccaccataggcacgcacagcgatcccctgcttttccagaaacgccagatcgttgcggatcgtcacagtagatacaccatacaacgccgatagatcattaacttgcacacttccttgctggcgcaggcgttgaatgatctgctctcgtcgctcactggtgcctgtcactcgcttctcacctgaagcgtcggtattactcatagtaagtcctttcgtaaaactttcgtttcatttcgttttgcctattaacgcctttctattaagcaaatgcaagcccaccttacccattggcgcaagctactctcgtttcagtggctttcattatgtttcttttgtgaatcagatcagaaaaccattatctttcgttttatttttatctcaccatgacgcagtatcaactgaaacaaaacgaaagattaatgtcgcagtaatctgaactggagaggaaagtgaaacatctgacagaaatggtgagacagcacaaagcgggcaaaacaaatgggatttacgccgtttgttccgcgcatccgctggtgctggaagctgcaatccgctacgccagtgcaaaccaaacgccgttactgattgaagcaacctccaatcaggtggaccagttcggcggttataccggaatgacgcccgccgattttcgcggctttgtttgtcagctcgccgactcgttgaatttcccgcaggatgcgctgattctgggtggtgaccatctggggccaaaccgctggcaaaacctgcctgccgctcaggcaatggccaatgccgatgatttgattaaaagctacgtggcggcaggattcaaaaaaattcaccttgattgcagcatgtcctgtcaggacgatccgattcccttaactgatgacatcgtggctgaacgcgccgcccgtctggcgaaagtggcggaagaaacctgtcgtgaacactttggcgaagccgatctggagtatgtcattggtaccgaagtgccggtacctggcggcgcgcatgaaaccttaagcgagctggcggtcaccacgccggatgccgcccgcgccacgctggaagcccatcgtcacgcttttgaaaagcagggtctgaatgccatctggccacgcattattgccctggtggttcaacccggcgtcgaattcgatcacaccaacgttattgattatcagtccgccaaagcgaccgccttaagccagatggtcgaaaactacgaaacgctgattttcgaagcgcactctaccgattatcaaacaccgcaatcgctgcgccagctggtgattgaccactttgccattctgaaagttggcccggcgctgacctttgctctgcgtgaagctctgttctctctggcggcgattgaagaagaactggtgccagcaaaagcctgttctggtctgcgtcaggtgctggaaaacgtgatgctcgaccgcccggaatactggcaaagccactaccacggtgacggcaacgcgcgtcgtctggcgcgtggttatagctactcggatcgcgtgcgctattactggccggacagccagattgatgacgctttcgctcatctggttcgtaatctggcggattcaccaattccgctgccgctgatcagtcagtatctgccgctgcagtacgtgaaagttcgctccggcgagctgcagccaacgccacgggaactcattatcaaccatattcaggacatcctggcgcagtaccacacagcctgtgaaggccaataagcaaaacaaagaggaacacgctatgccaaatattgttttaagtcggattgatgaacgcttgattcacggtcaggtcggcgttcagtgggtcggatttgcgggggcaaatctggtgctggtagccaacgatgaggttgccgaagatctggtacaacaaaacctgatggaaatggtactggcagaagggatcgccgtacgtttctggacgctgcaaaaagtcatcgacaacattcatcgcgccgccgatcgacagaaaatcctgctggtttgtaaaacaccggccgatttcctgacgctggtgaaaggtggcgttccggtgaatcgcattaacgttggcaatatgcactacgccaatggcaagcaacaaatcgccaaaacggtttctgtggatgcgggtgatatcgcagcatttaacgacctgaaagccgctggggtggaatgcttcgttcagggcgtcccaacagagcctgctgtggacctctttaaattactttgagggattcatcatggaaatcagtctgttgcaggcatttgcgttgggcattatcgcctttatcgctggcctggatatgtttaacggcttaacccatatgcaccgcccggtggttctcggcccgttggtcgggctggtacttggcgatctgcataccggtattttaaccggcggtacgctggaactggtgtggatggggctggcccctctggcgggcgcacagccgcctaacgtgattatcggtactatcgtcggcacggcgtttgccattactactggcgtgaaacccgatgtcgcggtcggtgtcgccgtacctttcgctgtcgcagtacagatggggattaccttcctgttctcggtgatgtccggcgtgatgtcccgctgcgaccggatggcggagaacgccgatactcgcggcattgaacgcgtgaactatctggcactgctggcactcggcacgttctattttctctgcgctttcctgcctatctacttcggcgcggaacatgcaaaaaccatcattgatgtcctgccgcaacgattaattgatggcctcggcgtcgcgggcggcatcatgccagcaatcggttttgccgtgctgctgaaaatcatgatgaaaaacgtctacatcccctacttcatcctgggctttgttgccgcggcttggctcaagttaccggtgctggctattgctgccgctgcgctggcgatggcgctgatcgacctgctgcgtaaatctcctgaaccgactcaacctgcggcacagaaagaggaatttgaagatggcatctaatcaaaccaccctgccgaacgtcagcgaaaatgaagaaacactgctgactggcgtcaatgaaaacgtgtatgaagatcagagcattggcgcggagctgacgaaaaaagatatcaaccgcgtcgcctggcgttccatgctgttacaggcttctttcaactacgaacgtatgcaggcttccggctggctgtacggcctgctgccagcactgaaaaagatccacactaataaacgcgacctggcgcgcgccatgaaggggcatatgggtttcttcaatacccatccgtttctggtgacgtttgttatcggcattatccttgcgatggagcgttctaagcaggacgttaacagtattcagagcaccaaaattgccgtcggtgcgccgctcggcgggattggcgatgcgatgttctggctaacgctactgccgatttgtggcgggataggtgcaagcctcgcgctacaaggctctattcttggcgctgtcgtctttattgtgctgttcaacgtggtacacctggggctgcgttttggtctggcgcattatgcttatcgcatgggcgtggcggctattccactcattaaagcaaataccaaaaaagtcggccatgcggcatctatcgttgggatgacggtaatcggcgcgctggtggcaacctatgttcgtttaagcaccacgctggaaatcacagcgggcgacgcagtggttaagttacaggctgatgttatcgacaaactgatgccagccttcttaccgctggtctacaccctgaccatgttctggctggtacgccgcggctggagtccgctgcgcctgattgcagtgacagtggttctcggcatcgtcggtaaattctgccatttcctttaaatacaatgaggtattagatgttaagtattattttgacagggcatggcgggtttgccagcggtatggaaaaagcaatgaagcaaattctcggtgagcaatcgcagtttatcgccatcgattttccggaaacctcaagcaccgcgcagcttacatcgcagcttgaagaggccatcgcccaactggattgtgaagacggcattgtttttctgacggatttgctgggcggcacgccgtttcgcgtagcttcaacgctggcgatgcaaaaaccgggctgtgaagtgatcaccggcacaaatttgcaactattactggaaatggtgctggaacgcgaagggttaagcggtgaagagttccgtgtgcaggcgctggagtgtggacaccgtgggctaaccagtctggtggacgaacttggtcgctgccatgaggaatgtccggtcgaggaaggaatatgacacacgttctgcgcgccagaaggctgctgactgaagagggatggctcgatgaccatcagttgcgtattgctgacggtgtaatcgcagcaatcgaaccgattccagtgggcgtgactgaacgcgatgtggaactgctctgccccgcttacatcgacacccatgtacacggtggtgcgggcgttgatgtaatggatgacgcgccggatgcgctcgacaagctggcaatgcacaaggcacgcgaaggtgtcggcagttggttaccgaccaccgtaaccgcgccgcttaataccattcatgcgacgctgaaacgtattgctctacgctgccagcgtggcggacctggtgcacaagtgctggggagttatctcgaaggaccgtacttcacgccgcagaataaaggcacgcatccgccggagctgtttcgcgagcttgaaattgccgagctggatcaattgattgccgtttctcagcataccttgcgcgtggtagcgctggcaccagaaaaagaaggggcattgcaggccatccgccatcttaaacagcaaaacgtacgggtgatgctggggcatagcgcggcgacctggcaacaaacccgtgccgcgtttgatgctggtgccgacggcctggtgcattgctataacgggatgacaggtttacatcaccgcgaaccgggaatggttggcgcgggattaacagacaagcgcgcctggctggaactgatagccgatggtcatcatgtacatccggcggcaatgtcgctctgttgttgctgtgcgaaagagaggatcgtactgatcaccgacgcgatgcaggcagccgggatgccggatggtcactatacgttatgtggtgaagaagtgcagatgcgcggtggcgttgtccgtaccgcgtccggtgggctggcgggcagtacgctgtctgtcgatgcggcagtgcgcaacatggtcgagttgacgggcgtaacgcctgcggaagccatccatatggcgtcgctgcatccggcgcgaatgctgggtgttgatggtgttctgggatcgcttaaaccgggcaaacgcgccagcgtcgttgcgctggatagcgggctgcatgtgcaacaaatctggattcagggtcaattagcttcgttttgatggtttgctcctttattaggccttcacttcccccgtaaggcctttctttttctttcgttttgatctgtgcagcggtgtcggatgcgacgctaatgcgtcttatccgacctacggttggtgagcgtaaggccggataaagtatttacgccgcatccagcaatcccttttacttcccttaccttttctttcaacgatcacagattttcgttttatttcctttttctccattgaactttcagtttcttttctatagattttaaccaacgaaagaaatcaccaagtgaaatgaaacgaaaggcaagcgaaagcgacaacgccgacgtcaagttcatcagactaaggattgagttatgccagaaaattacacccctgctgctgccgcaaccggtacatggactgaagaagagatccgccatcagcctcgcgcatggatccgttcactcaccaacattgacgcgctacgttccgcgctcaataacttccttgaaccgttactgcgcaaagagaatctgcaaatcatcctgaccggagccggaacatcggcatttatcggtgacatcatcgcgccgtggctcgccagccataccggtaaaaacttcagcgccgtaccgaccaccgatctggtcaccaatccaatggactacctgaacccagctcatccgctactattgatctccttcggtcgatccggcaacagcccggaaagcgtcgccgccgtgaaactggcaaatcaatttgtacccgagtgctatcacctgccgatcacctgcaacgaagcgggcgctctttaccaaaacgcgatcaacagcgacaacgcgtttgccctgctgatgcccgcagaaacgcacgatcgcggcttcgcgatgaccagcagcattaccaccatgatggcctgctgcctcgcggttttcgcacctgagatgatcaacagccaaaccttccgcgacgtggcggatcgttgccaggcgatcctgacctcactgggcgatttcagcgaaggtgtgtttggttacgcaccgtggaaacggatcgtttatctcggcagcggtggcttacagggcgcagcacgcgagtcggcgctgaaagtgctggaactgacagcgggtaaactggcggccttctatgattccccgaccggattccgtcatggcccgaaatcgctggtcgataacgaaacgctggtggtggtgtttgtctccagccacccttacacccgtcagtatgatcttgatctgctggcagaactccgccgcgataaccaggcaatgcgcgtaatcgccatcgccgcggaaagcaacgacgttattgccgccggtccacatatcatcctgccgccgtcccgtcactttatcgacgttgagcaggcattttgcttcctgatgtacgcccagacatttgcactgatgcagtcgctgcacatgggtaatacgccggataccccatcagccagtggcaccgttaaccgcgtggtgcaaggcgtaatcattcatccgtggcaggcataagaggatcgcattatgagcattatctccaccaaatatctgttacaggacgcccaggccaatggctacgcggtgcctgcctttaacattcataacgccgagacgatccaggcgatcctcgaagtgtgcagtgaaatgcgatcgccggtgatcctcgccggaacgccggggacctttaagcatatcgcgctggaagagatctacgccctgtgtagtgcctattccacaacctacaacatgccactggcgctgcatctcgaccaccacgaatcgctggatgatattcgccgtaaagtccacgcaggcgtgcgcagcgcgatgatcgacggcagtcatttcccgtttgccgagaacgtgaagctggtgaaatcggttgtcgacttctgccactcccaggattgcagcgtggaagcagaactgggccgcctcggcggtgttgaagatgacatgagcgttgacgccgaaagtgcattcctgaccgatccacaagaagctaaacgctttgtcgaactgactggcgtcgacagcctggcggtagcgattggtacggcgcacggcttatacagcaaaacgccgaagattgatttccagcggctggcggaaattcgtgaagtggtcgatgttcctctggtgctgcatggtgccagcgatgtcccggatgaatttgtccgtcgcactattgaacttggcgtaacaaaagtgaacgttgccacagaattaaaaatagccttcgctggcgcggttaaagcctggtttgcggaaaatccgcagggtaatgatcctcgttattatatgcgcgtcggaatggatgcgatgaaagaagttgtcagaaataaaattaatgtctgtggttcagcgaatcgaatttcagcataatcattagttttttatgatttatcccaatgtacttcccgattaatatcggggagtgccttaatggtaaaggagataactaaaccttaataaatacatcagtacaatatcgcaacaataatatatttaaaaagattatattattcaactttatggtgaggattacacaatgagcagtccaaatattctcttaacccgtattgataaccgtctggttcacggtcaggttggcgtgacctggacatccaccatcggtgcgaatctgttggtagtcgtggatgatgttgtcgctaacgatgctattcaacagaaattaatgggcattactgcggaaacctacggctttggcattcgtttctttactatcgaaaaaaccattaacgtcatcggcaaagctgcaccacatcagaagatcttcctgatttgccgtacgccacaaacggtacgtaaattggtagaaggtggtattgacctgaaagatgtcaacgtcggcaatatgcatttctcggaagggaaaaagcaaatcagcagtaaagtttatgtcgatgaccaggatctcacggatttacgttttattaaacaacgtggcgtaaatgttttcattcaggacgtccctggcgatcaaaaagaacaaatccctgactaaatctaaaatagccttaatattggtttgaggtaataaaaatgcatgaaataaccctactccagggattatccctggcggcgttagttttctttctggggattgatttttggctggaagccttatttttattccgcccgataatcgtttgtacccttacaggtgctattctcggtgatattcagactggcttaattaccggtggcctgacagagttgactttcgccggattaacccctgcaggtggtgttcagccgcccaaccctattatggcgggtctgatgaccactgtcattgcatggtctacgggcgttgatgccaaaacggcaattggtcttggcctgccgtttagtttgttaatgcagtacgtcattctgttcttctattccgctttctcattatttatgaccaaagccgataaatgcgcaaaagaggcggatacggcagcgttttcccgacttaactggacaacgatgctcatcgtcgcttcagcgtatgcggtgattgctttcctctgtacttacctggcacaaggggcgatgcaggcgctggtgaaagcgatgcccgcctggctgacccacggctttgaagtggctggcggtattctgcctgccgttggttttggcttgctgctgcgcgtgatgttcaaagcgcaatatatcccttacctgatcgccggtttcctgttcgtttgctacatccaggtcagcaacctgttgccggttgccgtactgggcgcaggctttgcggtgtatgagtttttcaatgcgaaatcccggcagcaagcgcaaccgcagcccgttgccagtaaaaatgaagaagaggactacagcaatgggatctgaaatcagtaaaaaagatatcacccgtctgggctttcgttcgtcactgctacaagcaagctttaactacgaaaggatgcaggcgggcggttttacctgggcgatgttgccgatcctgaaaaagatttataaggacgacaaaccgggcctaagcgcggcgatgaaagataacctcgaatttattaatacccaccctaatctggtcggattcctgatggggttattaatttcgatggaagaaaaaggagaaaaccgcgacaccattaaaggcctcaaagtggcgctgtttggcccaatcgccgggattggcgatgcgattttctggtttaccttgttgccaattatggcggggatttgctcatcgtttgccagtcaggggaacctgttgggaccgattttgtttttcgccgtttacctgcttatctttttcctgcgcgtcggctggacccacgtcggttattcagtcggcgtgaaggctattgataaagtgcgagagaactcgcagatgattgctcgttcggcaaccatcctcgggatcacagtaatcggcgggctgatcgcttcgtatgtgcatattaacgtggtgacgtcgtttgccatcgacagtacccacagcgtcgcactgcaacaggatttcttcgataaagtcttcccgaatattttaccgatggcctacaccctgctgatgtattacttcctgcgggtgaaaaaagcgcatccggtgctgttaatcggcgtgacgtttgttctttctattgtttgttctgcattcggcattttgtaaatggaacgaggcaccgcgtctggcggtgcctctttacttaaggaatttcatcctgtgcaaacccttcaacaagttgaaaactatacggcattaagtgaacgtgccagcgaatatttattggccgagatccgtcgcaaaccggatgccgtgatttgcctggcgaccggagccacgccattactgacgtatcattatctggtagaaaaaatccaccagcagcaggttgatgtcagccatctcaccttcgtgaagctcgacgaatgggtggatctgccattaacgatgcctggtacctgcgaaactttccttcaacagcatatcgtgcagccgctggggctacgtgaagaccagctcatcagctttcactccgaagagataaatgagacagagtgcgaacgggtaacgaacctgattgcgcgcaaaggcggtctggacttatgcgttctcggattggggaaaaacggtcatcttgggctgaacgaaccgggagaaagcctgcaaccggcctgccatatcagtcaacttgatgccagaacacagcaacatgagatgttaaaaaccgcggaccgtcccgtgactcgtgggatcaccttaggcctgaaggatattctcaatgcccgcgaagttttgttactggtgactggcgaaggaaaacaggatgcgacaaaacgttttctcacggctaaagtctctaccgctatcccggcttcatttttatggctgcataactatttcacatgcatgattgatgagatgtgtcgtcgttaactcgcctgctacaggcgttgcaacgctattcctgctgcgacgcctgtaatcactctccctgctgctccagcgcatacttatacagcgcatttttcttcacgccgtgaatttctgctgccagcgccgccgcttttttcagcggcagttctgcctgtagcagcgccagcgtgcgcagggcatcggcgggtaagtcttcttcctgtgctttatggccttcgacaatcagtaccatttcgcctttgcgacggttttcatcttctttgacccacgccagcagctcgccaacgggcgcgccgtgaatggtttcccaggttttggtcagctcacgcgccagaacgacgtagcgggattcgcctaataccgcaacgatatcttccaggctatctaacagacggtgggtagattcataaaaaatcagcgtgcgcggctccgcttcaatggcttttagcgcatcacggcggccttttgatttggcaggtaaaaagccttcataacaaaaacgatcggatggtaaacccgcggcgcttaacgcagtgatagcagcacacggcccgggtagcggcaccacgcgaatccccgcttcacggcaggtacgcaccagatggtagccaggatcgttaattagcggcgttccggcatcggaaaccagcgcaatgttttgcccctcttgcagcttcgccagcagcgtttcggctttttgttgttcgttatggtcgtgcagcgcaaacaaccgagcattaatcccaaaatgttgcagcaataaaccggtgtgacgcgtatcctcggcggcaatcagatcaacggcctgtaatacctccaacgcacgctgggtgatatccgccagattgccgattggcgtcggtacaatgtaaagctggccctgagaattatccgccgattggtgttgtttcattgtgtcgtccgtattgccgatttaatattgagcattgcgtaaaaaaaatatcactggatacattatggtaccctcaacattttctcgtttgaaagccgcgcgttgtctgcctgttgttctggcagccctgattttcgccggttgtggcacccatactcccgatcagtccactgcttatatgcagggcacggcgcaggctgattctgccttttacctgcaacagatgcagcaaagttctgatgataccaggatcaactggcaattactcgccattcgtgcactggtgaaagaaggtaaaaccgggcaggcggttgagttgtttaaccaactaccgcaagaactgaatgatactcagcgtcgcgagaaaacactgctggcggcagagattaaactggcgcagaaagattttgctggcgcgcaaaacttgctggcgaaaatcacacctgccgatttagaacaaaaccagcaagcccgttactggcaggcaaaaatcgatgccagccaggggcgtccttccattgatttactgcgcgcgttaattgctcaggaaccgctgctcggtgcgaaagaaaagcagcagaatattgacgccacatggcaggcgctctcctccatgactcaggagcaggcgaatacgctggtgatcaacgccgacgaaaatattctgcaaggctggctggatttgcagcgcgtctggtttgataaccgtaacgatcctgacatgatgaaagctgggatcgccgactggcagaaacgttatccgaacaacccgggcgcgaaaatgctgccaacgcagttggttaacgtaaaagcgtttaaacccgcatcgaccaacaaaatcgccctgcttttgccactgaatggccaggcagcggtatttggtcgcactattcaacaaggctttgaagcggcgaaaaatatcggcactcagccagtggcggcccaggtagcagccgcacctgccgcagacgtagcagaacaacctcagccgcaaaccgtgaatggcgttgccagcccggcacaagcttcggttagcgatctgaccggtgaacagcctgcgacccagccggtacctgtaagcgccccggcgacaagcaccgcagcggtaagcgcacccgcaaatccatccgcagagctgaaaatctacgatacctcatcacaaccacttagccagatcttaagccaggttcagcaggatggtgcgagtattgtggtcggtccgttgctgaaaaataacgttgaagagttgctgaagagcaacaccccgctgaacgtgctggcactgaaccagccggagaacatcgaaaaccgcgtcaatatttgttacttcgcgctttcaccggaagacgaagcgcgcgatgcagcgcgtcatattcgtgaccagggtaaacaagcgccgctggtgctgatcccacgcagttcattgggcgatcgcgtagccaatgcgtttgcgcaagagtggcagaaactgggcggcggcaccgttctgcaacaaaaatttggttccaccagcgaattacgcgcgggtgttaacggcggttcgggtatcgctttaacgggtagcccgattactcccagagaaacaaccgactccggcatgacgaccaacaatccaacgctgcaaaccacgccaaccgatgatcagttcaccaataatggcggtcgtgtcgatgcggtgtacattgtggcaacgccgggtgcaatcgcttttatcaaaccaatgatcgccatgcgtaacggtagccagagcggtgcaacgctgtacgccagctcccgcagtgcgcaagggaccgctggcccggatttccgcctggagatggaaggcttgcagtacagcgaaatcccgatgctggcaggcggtaatctgccgttaatgcagcaggcgctcagcgcggtgaacaacgattattcgctggctcgcatgtatgcgatgggcgtcgatgcctggtcgttggcaaatcatttctcacaaatgcgccaggttcagggttttgaaatcaacggtaataccggaagcctgacggcaaacccggattgcgtgattaacaggaagttatcatggctacagtaccaacaaggtcaggtagtccccgccagttaaccaccaaacagaccggcgatgcgtgggaagcacaagcgcgtcgctggctggaaggcaaaggactacggtttatcgccgctaacgtgaacgagcctggcggcgagatcgatctgataatgcgtgaaggccggaccaccgtttttatcgaggtgcgttaccgccgctctgcgctttatggcggcgcggcagccagtgtgacccgcagcaaacaacacaaattattacagactgcccgcttgtggctcgcgcgtcataatgggagttttgatactgtggattgccggttcgatgtggtagccttcaccgggaatgaggttgagtggattaaggatgcctttaatgaccactcataattaaggtttaaggattagcgtgcaagaaagaattaaagcttgcttcactgaaagcattcaaactcaaattgcggcggcagaggcgcttccggatgccatctcccgtgcagccatgacgctggttcagtctctgctcaatggcaacaaaatcctctgttgtggtaatggaacttccgctgccaatgcacagcattttgctgccagcatgatcaaccgtttcgaaacggagcggcccagcttacctgccattgcactaaatactgataatgttgtcttaacggcaattgccaacgatcgcttacatgatgaagtgtatgcaaaacaggtgcgggcgctgggtcatgcgggagatgtattgttagccatttccacccgtggcaacagccgcgatattgtaaaagcggtagaagctgccgttacgcgtgatatgaccattgtggcattaaccggctatgacggcggtgaacttgcaggtttgttagggccacaggatgtggagatccgcattccttcgcatcgtagtgctcgcattcaggaaatgcatatgctgacggtaaattgcctgtgcgatctgatcgataacacgcttttccctcaccaggatgtttaaggagaatacatgaaggcattatcgccaatcgcagtccttatttccgcgctgctgttgcaaggttgtgttgccgctgccgtagtgggtactgctgctgtgggtaccaaagccgcaactgacccacgcagtgtcggcacccaggtagacgatggtaccctggaagtgcgcgtgaacagcgcattgtcgaaagacgaacaaattaagaaagaagcgcgcattaatgtaacggcctatcagggcaaagtgctgctggttgggcagtcaccaaacgctgaactttcggctcgcgccaaacagattgctatgggcgtagacggtgccaacgaagtgtataacgagattcgtcagggccagccgattggtctgggcgaagcgtctaacgatacgtggatcaccaccaaagtacgttcgcagctgttaaccagcgacctggtgaaatcgtccaacgtgaaagtgaccaccgaaaacggtgaagtgttcctgatggggctggtgactgaacgtgaagcgaaagcggcggcagatattgccagccgggtaagcggcgtgaagcgggtaactacggcgtttacgtttattaaatagcagcccttgtaatgcctgatgcgacgcttgcagcgtcttatcaggcctacaacgatgcaaaccgtaggtcggataaggcgtttacgccgcatccgacatgttttccctcaaatcaaaccaacagcgccagcccgccgacaatcacaccagacactgccaccatcgcccccgtcagccataaggctttcgccggaaacgctttacgcaacattatcagcgacggcaaactcaccgccgggagcgtcatcaacaatgccagcgccggaacggttcccatacctgccagcatcatcgtttgtacaatcggaatttctgctgccgtgggaatgacaaacaagcatcccgctaccgccatcgccaccacccacatcaggctgttatcgacagcaccatcggcatgggggaataaccagacgcgagcggcacccaacaccagtactgcaaggatgtaaaccgggatcgtactccagaaaagcgtccatagcgccctgccccagcggctaaaaaaaccgccctgtgattccggtatgtcaatttcgaccggtgcctgcgtttgcggtgtttcacgcacccatttttgcaccagcgtcgcaatcagcaacaccatcaccagccccgccaccagacgaatcgccgcaaaaccccagccgaggacgaaccccataaacacaagcgtcgccgggtttaacaacggattccccatccagaatgccagcgcaccgcccatcgacacctgttggcgacgcattcccgccgcgaccggagccgcacagcaggtacacatcatgcccggcagcgaaaacagcgttcccagcagcgtgccgcgaaagcgcgattgcccaagcgtacgcaacaaccagtcacgcgggatcagcacctgaatcaacgaaccgaggatcacccccagcaccgccgctttccataccgcgaggaaatagatcatcgcgtaatccaacgccgcctgccacggattatcatccgcctgcgcaaggatagatttaccgatactgtgggtttcggcagcagtaaacgctttgccgtagtaaggttgccatttcacataccagagaccggcaatgacaacgagaaagaaaagcgcggttttccaccactgaatgggcgttgccgcctgagatgaagactgaccagtcatagcattccccaggaataagttatgataattgagcgcgtgaatattacgctcactatcaattcttgggaataattattcagctcttttgcgtaattctgaagagcttaaaatcgtcacaccttcatgctcaggccgcatcgcctctgccagcatgacccgcgccacgtctctcgcatcaatggatttccagttaccgggtaacaaacggaacagcggcgcaaaaagcgtttcgttcatccgctgtttgctacgatcacccagtaacatcgacgggcgagcaatggtcaatttcggccagttctgggcgattaatgcttcttccatctcccctttgacgcggttatagaaaaacggcgagtgggcattagcacccatagcactgaccaccagcatatgctgcgcaccgagccgccgcccggttaatgcggtatccaccaccagcgtgtaatcggcatgaataaacgcctctttgctccccgcttctcgccgcgtggtgccgagacaacaaaacacaatgtcgatgggatcggtgacctgcgccagcgcgtcagtcagttgcggatcatggggattaaacaccccgggcatatcgcccaacgggcgtcgcgtcggcgcagcaatggcgttaactttcggttcattaatcaacatccgcagcaggtgaccgcccaccagccccgttgcgcctgtaatcagtacctgactcatcttcgctcctttacagaattgtctgccttgcgctccccggctcatacaccaggcttaatagaccatgaggtaattatccccgattgtggaaaattcgcctcatccaatgcaacaacgcggaggaagcatgagtaagaaaatcgccgttttaatcactgatgaatttgaggattcagaatttacttcacccgcagacgagttccgtaaagccggacacgaagtgattaccattgaaaaacaagcgggtaaaacggtgaaaggcaaaaaaggagaagccagcgtggccatcgataaatccatcgatgaagtgacgcccgcagagttcgatgccctgctgctaccgggcggtcattcaccagattatctgcgtggtgacaaccgttttgtcaccttcacacgcgattttgtgaacagcggcaaacctgttttcgccatctgtcacggtccgcagctgctgatcagcgccgatgtgattcgggggcgtaaactgactgccgttaaaccgatcattattgatgttaaaaacgcgggcgcggaattttacgatcaggaagtggtggtcgataaagatcagctagttaccagccgtacaccggacgatctgccagcgtttaaccgcgaggcattacgcctgctcggtgcctgagttacgtagccagatcatttttttaccaaagcccagcgtgttgtcggtgaatttgatttcatcaagccggatttcccacaccggggccgacagcattctggcaaccggaaagcgacgattgtacgcctggcgcgcaaggtcgctttcctcgccttccagtctgcggatctcgcctttaaattgcacgccgcgaattaacgctaccgttttcggctgaccgtttaccgttccggcaactgccgcctgcggcccactcatctgcgcgtggcgcgttttttcttccgtcaaaatgtagaaggcgactttctgcgcatcaaaaagataaaaggcattagcgcaccagagttccccttcctgctgcacacaccaggtgacaacatgttgttttgccagccaacggctgatggcggtgagtgtttccattgctgttctcttttatactgtgggcctgaccttaacatgcgacgcagacgatgacaccctggtttctttacttgatccgtaccgccgacaataagctttataccgggatcaccacagatgtcgaacgccgctatcagcagcaccaaagcggcaaaggggcgaaagcactgcgcgggaaaggagaactaacgctggcgttttccgcgccagtgggcgatcgttcgctggcactacgggcggaatatcgcgttaagcaactgaccaaacggcaaaaagagcgtctggtagcggaaggcgcagggtttgcagagctgttgagcagcctgcaaaccccggagattaaaagcgattgaaatgctcgtgatactcaaccagaccggttacgccgttcagcgcgtcatccgctaaacgatgtacctggaaggcgctttcagtgcccggccagcggcaacgcagatcgtgatgcgccgccagttcaaagccgaaacgactgtacagcgccggatcgcccagcgtcaccactgcggcatagccgaactcattgagcgaatcgagtccttcatagaccagttggcgtgccagcccctgtccacggtatttttcatctaccgccagcggtgccatgccaacccattgcaggtcttcgccctgcacatcaaccggactaaatgccacatagccaatgacctgaccttcgtcatctgtcgccaccagccccaacgtcagaaagccatcttcacgcagatcgtgaaccagcttcgcttccgcatcactttcgaatgaacgacgcagcagggcatcaatacccggcgcatcaatgggaatttctactcgaattagcatggttcacctaccgatgtctgtttggtttcaggcgcggttttcattcccgcctcaacaaaatccgccagttgcagcagcatcatgcgtaaggctttcggcatttgctccagttcaatggcgtccatcaggtttttcacatacagccccagctccgtatcgccttcaatcgccagccgacgctggaagaagagcgtatccggatcttgtttacgcgccgcaatcatcagcagatcgctggcgtcggcactaaaactcacatcagcttgcgcgttctggctaacgaccagtttgccattcaccaccgaggtaaaccattgcaggtcaatatcacgcacatgaatacttaaccagcggccttcaagaaactccagctcgccatcatccagcgcctgacggaattgccagcttaagacctgctcaagaacctggcgttttagcgcaaatggcgtcagttttaccggtacactcaacagagatggccccaaatgcacaatacgggaacgcagtttatccaacacgagttttactccctgtttcaacaatcatcctattttgccatatcagaaaaataacatagcggtataaatcaacaattccatatgaaattgctgctaccaccaatacaactttaactgccttaaatcaaaaattgtcgcagcaaggttaactaaaatcccagttcgttaacatttttgcgttttgatagcgcaaccttcaggaaaaattatggagctgctctgccctgccggaaatctcccggcgcttaaggcggccatcgaaaacggcgcagatgctgtttatatcgggctaaaagatgataccaatgcccgtcacttcgccggccttaactttaccgagaaaaaattgcaggaagcggtgagttttgtccatcaacatcgccgcaaacttcacatcgcgattaacacttttgcgcatccggacggttacgcccgctggcagcgcgccgtggatatggcggcgcagctgggtgccgacgcgctgatcctcgccgacctcgccatgctggagtacgccgccgagcgttatccgcatattgagcgccacgtatcggtgcaggcttcggcgaccaatgaagaggcgattaacttttatcatcgccattttgacgttgcccgcgtggtgctgccgcgcgtgttgtcgattcatcaggtgaaacaactggcacgggtcacacctgtaccactggaagtctttgctttcggcagcctgtgcattatgtcggaaggtcgttgctatctgtcgtcgtatttgacgggtgaatcgcccaacaccgtgggtgcgtgttctccggcccgtttcgtgcgctggcaacaaacgccgcaggggctggaatcccgcctgaacgaagtgctgatcgaccgttatcaggacggcgaaaacgcaggttatccgacgctgtgtaaagggcgttatctggtggacggcgagcgctatcacgcgctggaagaaccaaccagtctcaatacccttgagctgctgccggagttaatggcggcgaatatcgcttcggtgaaaattgaaggccgccagcgtagcccggcgtatgtcagccaggtggcgaaagtctggcgtcaggctatcgaccgttgtaaggccgatccgcaaaacttcgtgccgcaaagcgcgtggatggagacgctcgggtcgatgtccgaaggcacgcaaactacccttggcgcgtatcaccgtaaatggcagtgagaaaagcaatgaaatattccttagggccggtgctatggtactggccaaaagagacgctggaagaattttatcagcaggccgccgccagcagcgccgacgtgatttatcttggtgaagcggtctgtagcaaacgccgggcaaccaaagttggcgactggctggagatggcaaaatcgctcgccggaagtggcaagcagattgtgctctccacgctggcgctggtgcaggcatcctccgaactgggcgaactgaaacgctatgttgagaacggtgagtttctgattgaagccagcgatctcggcgtggtgaatatgtgcgctgaacgcaaactgccgttcgtcgccgggcacgcgctgaactgctacaacgcggtgacgctgaaaatattgctcaaacagggcatgatgcgctggtgtatgccggtggagctttcccgcgactggctggtgaatctgcttaatcagtgcgatgaactgggcattcgcaaccagtttgaagtggaagtcttgagctacggtcatctgccgctggcctactccgcccgctgctttaccgcgcgttcggaagaccgcccgaaagatgagtgtgaaacctgctgcattaaatatccgaacgggcgcaacgtactgtcgcaggaaaaccaacaagtgtttgtactcaacggcattcagaccatgagcggctacgtttacaacctcggtaacgagctggcatccatgcaggggcttgtcgatgtggtccgcctgtcaccgcagggtactgacactttcgcaatgctcgatgccttccgcgctaatgaaaatggcgctgcgccactaccgttgacggcaaacagcgactgtaacggctactggcggcggctggccgggctggagctgcaagcgtaagtatatagctcactttgttaacaactttaactactctttaatgcagtattaaagactaatcggtaacaaagtgagctgttatgactgataaaaccattgcgttttcgctactcgatctggcccccatccccgaaggttcttcagcgcgggaagcgttctcccactctctcgacctcgcccgtctggctgaaaagcgcggctatcatcgctactggctggcagaacaccacaatatgaccggcattgccagtgctgcaacgtcggtgttaattggctatctggcggcgaataccaccacgctgcatctggggtctggcggcgtgatgttgcctaaccactcaccgttggtgatcgccgaacaattcggcacgctcaatacgctctatccggggcgaatcgatttggggctgggccgcgcgccgggtagcgatcagcgaaccatgatggcgctgcgtcgtcgtatgagcggcgatattgataatttcccccgcgatgtcgcggaactggtggactggtttgacgcccgcgatcccaatccgcatgtgcgcccggtaccaggctatggcgagaaaatccccgtgtggttgttaggatccagcctttacagcgcgcaactggcggcgcagcttggtctgccgtttgcgtttgcctcacacttcgcgccggatatgttgttccaggcgctgcatctttatcgcagcaacttcaaaccgtcggcacggttggagaaaccgtatgcgatggtgtgcatcaatattatcgccgccgacagcaaccgcgatgccgaattcctgtttacctcaatgcagcaagcctttgtgaagctgcgccgcggcgaaaccgggcaactgccgccaccgattcaaaatatggatcagttctggtcgccgtccgaacagtatggtgtgcagcaggcgctgagtatgtcgctggtgggcgataaagcgaaagtgcgtcatggcttgcagtcgatcctgcgcgaaaccgacgccgatgagattatggttaacgggcagattttcgaccaccaggcgcgcctgcattcgtttgaactggcgatggatgttaaggaagagttgttgggatagtatgtcttaacgcgggaagccttatccgagctggcaacgctgtcctacgtaggcctgataagcgaagcgcatcaggcattgtgtaggcagcagaaatgtcggataaggcaccgctgattactgatacaccggcagcaaattaaagctcgataagatatggaccagtgcgttgccaacgccaaataccagaatcagcataatcatcggcttgccgccccagacgcggaatttcgggctaccaaagcgtttacgcgatgcgcgggccaacagcgccggaacaattgccgcccagatggtagccgctaagccagcataaccaatggcgtacaggaatccgttaggaaacagcaggccacccacaacaggcggggcaaaggtcagcaacgctgttttcaaacggcccatagccgagtcgtcaaaaccaaacagatctgccagatagtcaaacaaacccagcgttacgccaaggaacgaactcgctaccgcaaagtttgagaacacgaccagtagaagatccagactacggctgttcagtacgccgcttaacgcctgtaccagcacatcaatattaccgcccttctcggcgataccgataaactccggacgcgggatgttacccatcgtcgccagcaaccagatggtatacagcgccagcgccatcagcgtaccgtacaccaggcatttcacgatggttttcggatctttgccgtaatacttcatcaggctcggcacgttaccgtgataaccaaaagatgccagacagaatggcagtgtcatcagcagatacggcgcataagacgcattgctttcggcgacgttgaacaaggtcgttggctgtacatgccccagcaggctgccgaaggtgaggaagaaagtaatgactttcgcccccagcacaattgctgtcatccggctgacagctttcgtactcaaccacaccacgaacgctaccagcagtgcaaaaccaaatccagctgcccgtgcagggacgttcagcgacatctccgcgaaggtgtgatgcagaatcgaaccgctggcagaaatataagcgtaagtcaggatatagagcacaaaggcaatggaaatgccgttgactacgttccagcctttgcccagcaaatctttggtgatggtgtcaaagctagaaccgattcgataattcaggttagcttccagaatcatcaagccggaatgcagcatacagaaccaggtaaagatcagcgccgccattgaccagaagaaccacgccccggacatgaccacaggcagagaaaacatccctgcgccaataatggtgccgccgataatcaccacgccgccaagcagcgacggtgacgtttgggtggtggttagtgttgccatgagggcttctctccagtgaaaaatagtgcgactgcgttgttatgcattgcactgtaccagtacacgagtacaaaagacagaaaaaaagccccgattgttaaaatcggggctgtatatattattttacagattgtgttcgctgtttagcgatgattacgcatcaccaccgaaacgacgacgaccggtagagtcatcacgacgcggagcgcggccttcacgacgttcgccgctaaaacgacgaccatcaccacgaccaccttcacggcgttcaccgctgaagttacgaccgccttcacgacgttcgccaccgaaaccacgaccaccaccacgacgctcaccaccagtatgcggctgtgcatcgcccagcaactgcatgttcatcggcttgttgagaatgcgagtacgcgtaaagtgttgcagcacttcacccggcatacctttcggcagttcgatggtggagtgagaagcaaacagcttgatgttaccgatgtaacggctgctgatgtcaccttcgttagcaatcgcgccaacgatatgacgaacttcaacaccatcatcgcggcccacttcaatacggtacagctgcatatcgccaacatcacgacgttcacgacgcggacgatcttcacggtcgccacgcgggccacggtcgttacgatcgcgcggaccacggtcatcacggtcacggaattcacgtttcggacgcatcggcgcatctggcggaacaatcagagtacgttcaccctgtgccattttcagtagtgcggctgccagagtttcgagatccagctcttcaccttcggcagtcggctgaattttgctcagcagtgcacggtattgatccagatcgctgctttccagctgctgctgtactttagcggcaaatttttccagacgacgtttgcccagcagttctgcgttcggcagttctacttccggaatggtcagcttcatggtgcgttcgatgttgcgcagcagacgacgctcacggttctcaacgaacagcagtgcacgaccagcacgacctgcacgaccggtacgaccgatacggtgaacgtaagactcagaatccatcgggatatcgtagttaaccaccaggctgatacgctcaacgtccaggccacgggctgcaacgtcggtcgcaatcaggatgtccagacgaccatctttcaggcgttccagtgtctgctcacgcagcgcctggttcatgtcaccgttcagcgcggcgctgttgtagccgttacgctcaagagcttctgccacttccagagtcgcgtttttggtacgaacgaagataatcgccgcatcaaaatcttccgcttccaggaaacgtaccagtgcttcgtttttacgcataccccagacagtccagtagctctggctgatgtcaggacgggtagtcacgctggactgaatgcgcacttcctgcggctctttcataaagcggcgggtaatgcgacgaatcgcttccggcatggttgcagagaacagagcggtctgatgaccttccgggatctgcgccataatggtttcaacgtcttcgatgaagcccatgcgcagcatttcgtcagcttcatccagaaccagaccgctcaatttagagaggtccagagtgccacgtttcaggtggtccagcagacggcccggagtaccgacaacaatctgcggcccctgacgcagggcgcgtaattgcacgtcataacgctggccgccgtacagggcaaccacgtttacgccgcgcatgtgtttagagaaatccgtcattgcctcagcaacctgtaccgccagttcgcgggtcggtgccaacaccagaatctgtggtgctttcagctcaggatcaagattctgcagcagaggtaaagagaatgctgcagtttttccgctccccgtctgggccatacccagaacgtcgcggccattcagcagatgtggaatacactctgcctgaattggagatggtttttcgtaacccagatcgttaagggcttcaaggataggagccttcaggcccagatctgcaaaagtggtttcgaattcagccatgtagtacgtgtgcctcaaaattaatggcggccagtctacataactcatcatgaaattgatcagcaattttcattgaaaagtgtgaaccggctcaaagtaggtgtattaacgaacaacaacgccctcacccgttaaggtgatggcaatcaaaaaagattacgggctgatgtgtacgtcagctattgctggtccgattctgccaggtcatcttggtcctggcccaggagcgataattccaacaatgcgtatcggtgctcaacaaagttatgaacgttgttggcaaccgccagtttgaacagtgccgtggcgctgtccaaatcccccagacttaggtagtacttacctaaatagaagttggtttcactgagatgctcagcgagcgaggtgttatccgttgcgtccgccttgagcctttccattaacgtttgttcgctaatgttgcccaggtagaactcgacaatgttccatccccactgttccttatccgatttttcgaagtgctgtttcaacacttctttagcctgcttctcatcgagcttctgctcggcgagataaagccacagactacggaaaggatcattgggatcgtcttgataaaacgccagcagatcatcttgcgctaacttgtcacgaccgccgtaatataatgcgatcccgcgattcaagtgcgcgtagttgtaagttggatcaagctcaagtacagaatcaaacgcttcataggcagcatcaaaattgcctgcctgcgttaaatatatgcctaagtaattgaatacttcaggcatatccggtcggattgccagcgcttgcgaaaaatcgttacgcgctaatgccctcagaccgagactatcatacaacactccgcgctcatataaaagctgtgcgcgttcgtcatcggttaaagcccgactggcaaggatctgttccatacgtgccagaatcacttcctgctgtaaagtcggttgcaatggtaccgcgagaacttcacttttacgccaggaagtattactgcatcctgcaagcgtaagtgctgtcgcaacgaaacaccagcgcaaaaaaggcttcatttcccactcccgaagaccacggttgaatgaacgtcctgttcccagttgctaacaaggcgtcctgcccggttaaaagccccccgccgcagcggagggcaaatggcaaccttactcgccctgttcagcagccggagcttccggtgctgcagcaggttgagactgctcagtcgcttctttaatgctcagacggatacggccctggcgatcaacttccagcactttcaccggtacttcctgacccatctgcaggtaatcggtcactttctcaacgcgtttatcagcgatttgagagatgtggaccagaccttctttaccgccaccaatggcaacaaatgcgccaaagtcaacgatacgggtcactttaccattgtagacgcggcccacttcgatttctgcagtgatctcttcgatacgacgaatcgcgtgtttcgctttctcgccgtcggtcgctgcaatcttcacagtaccgtcatcttcaatttcgatggtggtgccggtttcttcggtcagagcacggattacagaaccgcctttaccgataacatctttgatcttgtccgggttgatcttgatggtatggatacgcggtgcgaactcagagatatcgccacgcggcgcgttgatcgcctgttccattacccccaggatatgcagacgcgcacctttagcctggttcagtgcaacctgcatgatctctttggtgataccttcaattttgatatccatctgcaatgcagagataccgtcacgggaacccgcaactttgaagtccatatcgcccaggtgatcttcgtcgcccaaaatgtcagacagtacaacgtagttgtcgccttctttcaccagacccattgcgatacccgcaacggcagctttgattggcacacctgcgtccatcagcgccagagacgcgccgcacacggaagccatagaagaggaaccgttggattcggtaatttcagacacaacacgtacggtgtacgggaatttgtccatatccggcattactgccagcacgccgcgcttcgccagacgaccgtgaccaatttcacgacgcttcggagaaccgaccatgccggtttcgcctacggagtacggagggaagttgtagtggaacaggaaggtatcggtacgttcgcccatcagttcatcaagaacctgcgcgtcacgagcagtacccagcgttgcggtaaccagcgcctgcgtttcaccacgggtgaacagcgcagaaccgtgagtacgcggcagcacaccagtacgcacatccagaccacggatcatatctttttcacgaccgtcgatacgcggttcgcctgccagtacgcggctacgaacaacatttttctcgatagcgtgcagaatttcacccagttcgttttcgtccagggtttcgtcttcagcaagcagtgtcgcgatggtttcagatttgatgacatcaacctgcgcataacgctcttgtttgtcggtgatgcggtaagcatcgctcagacgagcttcagccagcgcagcaacgcgcgcgttcagcgcttcgtttaccggctccggctgccaatcccaacgcggtttaccggcttctttcaccagttcattgatgttctgaataacaacctgctgttgttcatgaccgaagactactgcgcccagcatctggtcttcgctcagcagttcagcttcagattcaaccatcagtacagcggcttcagtacccgcaacaaccagatccagtttgctctctttcaactcgtcctgagtcgggttcagtacgtactggtcattgatgtaacctacgcgggcagcaccaatcggaccattgaacggaataccagacagagacagtgctgcggaagcaccaatcatcgcgacgatatccgggttaacttgcgggttaacagaaaccacggtggcgataacctgaacttcgttgacgaagccttccgggaacagcgggcgaatcgggcggtcaatcagacgcgcgatcagggtttcgccttcgcttgggcggccttcacgacggaagaagctacccgggatacgaccagcagcgtaggtacgctcctgatagttaacggtcagcgggaagaagtcctgacctggtttggcttttttctgaccaacaacggtaacaaataccgcggtgtcatccatgctaaccataacagcggcagtagcctgacgagccatcatgccggtttccagagtcacggtgtgttggccgtactggaatttacgaacgatcggattaagcaatgtaatatcctttctctttcttagacagtaccttacggtactggtgttaatacccgatcttctgcgcatcctcgcgactaatgacaaccctaacccagctctatgtgggtaaagcctctcattagccgcgcgaacctctgcaacggaagatcattcatagcaacaatacattagtttccagtgaattgctgccgtcagcttgaaaaaaggggccactcaggcccccttttctgaaactcgcaagaattagcgacgcagacccaggcgctcgatgagctgggtgtaacgtgctacgtctttacgtttcaggtagtcgagcagtttacgacgctgagaaaccatgcgcagcagaccacgacggctgtggtgatcttttttgtgctctgcaaagtggccctgcaggtggttgatctgtgcagtcagcagtgctacctgaacttcggtagaaccggtgtcgtttgcgtcacgaccaaactcagaaacgattttagctgttgcttcagtacttagagacattttaaaactccaaagtatatagaatgaaaggacgccgatctctaattcagcgatcccagtgtacgttacgcaaagtgttaaacaatttacgcgacgttaagcggcagtattctactcgtagcgacctgttatcgcaagacggttaacattacgccgggtattcaaccaccaggcgacgaggcgcaacgcggccttcatcgtcaatttcgcccataccgataaacttgccgttctcaccctctgtaacgcgaaccagtccttccagcggcgcaccggatgtacgaactgggttaccatttttgaagtaaacagaagacgttaacggaagattcaccactgggtagtccgaagctggactgtccattggcatcagtaatggatcaagtaactccgcagccggaatatcctgctgttcggcttgctcaaccagttcacgcagatgttccagggtcaccatccgttcaaccggatatttacttaccgccagacgacgcaagtaaataacatgcgcgccacaaccgagtttttcgccgagatcgtcaatgatagtgcggatataagtgccttttgagcagtgaatttccagctccagctcattgccttcatggcgaataaacagcaattcaaaaacggtaatcgggcgcgcttcacgcggaacttcaatgccctgacgcgcgtattcgtacagttttttgccctgatatttcagtgctgaatacatcgaagggatctgttcgatatcgccacggaaggtatccagcgccgccgccagttgctctgcactaaaggttaccggacgttcttcaacgatttgtccgtcggcatcagaagtatcggtacgctgtccaagacgcgcaatgacccgatagcgtttgtcggagtccagcagatactgggaaaacttcgtcgcttccccgaggcaaattggcaacatgccggtcgccagcgggtccagcgcaccggtatgcccggcacggttggcgttataaatccgtttcactttttgcagcgcatcgttgctggacatcccctgcggtttatccagcaacaaaacgccgttaatgtcgcgaccgcgacgacgaggacgactcattagtcctccttgctgtcgtccgggttaacacgacgttcttcgtcatgtttgaccacgctggtcaccaggtttgacatgcgcatcccttcaaccagagagttgtcgtagaagaaggtcagttccggcacgatacgcaggcgcatcgctttccccagcaggctgcggatgaaaccagaagcttcctgcaacgctttgatgcccgctttaaccgcgtcttcatctttgtcgttgaggaacgtcacatatactttggcatacgccaggtcgcgagacatttcgacaccggaaacggtggtcatcatgcccagacgaggatctttaatttcacgctgcaggatgagagcgatctctttttgcatttcctgcgctacgcgctgcgggcgaccaaattctttcgccataataaattctcctgacaaaaaaggggctgttagcccctttttaaaattaatttcaggtggaagggctgttcacgttggcctgataagacgcgccagcgtcgcatcaggcaatccatgcaggatgcgacataaacgccttatcccgcatggaaccctaaaaaccttaagcgatagtacgttggatctcgatgatttcgaatacttcgatcacatcgccagtgcggacatcgttgtagttcttaacgccgataccacattccataccgttacggacttcgttaacgtcatctttgaagcgtctcagggactccagctcgccttcgtagataaccacgttgtcgcgcagaacgcggatcgggttgtgacgtttaaccacaccttcggtaaccatacaacctgcgatagcaccaaatttcggtgatttgaacacgtcacgaacttccgccagaccgataatctgctgtttcagttccggagacagcataccgctcatcgccgctttcacttcgtcgatcaggttatagatgacggagtagtaacgcagatccaggctttccgcttcaatcactttacgtgcagaggcatcagcacgtacgttgaagccaaccaggatggcgttggacgccgcagccagggtagcgtcggtttcggtgataccacctacgccagaaccgatgatcttcactttaacttcgtcagtagacagtttcagcaaggagtcggaaattgcttccacagaaccctgtacgtctgccttcaggacaatattcacttcgtgaacttcgccttcggtcatattggcgaacatgttctcgagtttagatttctgctgacgcgccagtttaacttcgcggaatttaccctgacgatagagtgcaacttcacgcgctttcttctcgtcacgtacaacggtaacttcatcacccgcagccggtacgccggacaggccaaggatttccaccggaatggacggacccgcttccagcacttcctgacccagttcgttacgcattgcacgaacacgaccgtattcgaagccacacagaacgatatcgcccttgtgcagagtaccttcacgtaccagaacggtagcaaccggaccacgacctttatcgaggaaggattcgataaccgcaccgctcgccatacctttacgtaccgctttcagctccagaacttccgcctgcagcaggatagcatccagcagttcatcaataccggtacccgcttttgcagatacgtgtacgaactggctttcgccgccccactcttctggcaggatgccgtactgggagagttcgttcttaacgcgatccggatcggcttctggtttatcgattttgttcacagcaaccaccaccggaacacccgccgctttcgcgtgctggatagcttcgatggtctgcggcattacaccgtcgtctgcagcaacaaccaggactacgatgtccgttgcctgcgcaccacgtgcacgcattgaagtaaacgcggcgtgccccggggtgtccaggaaggtgatcatgccgttttcagtttcaacgtggtatgcaccaatgtgctgggtaatgccgcccgcttcgccagaggccactttcgttgaacgaatgtagtccagcagagaggttttaccgtggtcaacgtgacccatgatggtcacaaccggcgcgcgcggttcagccgcagcacccgtgtcacggtcgctcattaccgcctcttccagctcgttttcacgacgcaggataactttgtggcccatctcttcagcaaccagctgtgcggtttcctgatcgataacctggttgatggttgccattgcgcccagtttcatcatcgctttgatgacctgagagcctttaaccgccatcttgttcgccagttcgccaacggtgatggtttcgccgatcacaacgtcacggttaacggcctgagctggcttctggaagccttgctgcagcgaagaacctttacgttttccgcccttaccgccacgtactgctgcgcgagcttcttcacgatcagcttttgattcagcgtgtttgttgcccttcttcggacgcgctgctttcgcgttacgaccacggccacggccgccttcgacttcacgatcgctttcgtcttctgcctggcgagcatgttgagaagtagtgacgtgataatcgctggaatcttcagtcggttctgcgttatcaatccatttgttttcttccgccatacgacgtgcttcttcagcaacgcgacgtgcttcttcttcgagtttacgacgcgcttcttcttcggctttacgcttgagctctgcagcttcctgctcacggcgggctttttcagcctgggcgtttttagtcatatcgtcttgttgattgctcactttgtctttttccgcagcttcacgtttcgcttgttcagcagcttcacgcttagcctgttctgcggcctcacgttcagctttttgttgcgcctcgcgtttagccgattcttctgcctcacgacgggcttgctcttccgcttcacgctgcgcttgctcttccgctgcaaggcgctcagcctcttgcggatcgcgtttcacaaaggtgcgtttcttgcggacttcgatttgtaccgatttgctttttccaccggtaccaggaatgttaagggtgctgcgtgttttacgttgcagcgtcaatttgtccgggcctgaatttttctgattcaggtggtcaatcaaagtctgtttctcttgtgcagacacagagtcgtcagcagacttccggatacctgcatcagcaaattgctgtaccaggcgttccacggaggtctgtcgctctgcggccagcgttttaatcgttacatctgtcatgctgttccttcctgctacagtttattacgcttcgtcaccgaaccagcaaatattacgggcagccataatcagtgctccggctttttcgtcggtcaacccttcgatatcagccagatcatcaatgccctgttcggcgagatcttccagcgtacaaacgccacgggcggccagtttgaatgccaaatcacgatctaccccttcaaggttcagcagatcgtcagccggtttgttatcaccgaggctttcttcctgggcctgtgcaatggtggccagtgcatttttagcacgctcgcgcagtgcttcaacggtcggctcatcaaggccttcgatttccaacagctctttcatcggcacataggccagttcttccagcgtcgagaagccttcttctaccagaacagtcgcgaagtcttcatcgatgtcgagatatttggtgaaggtgtcgatcgctgcgtgcgcttccgcctgatgcttagcctgcaggtcgtcaacggtcatcacgttgagttcccaaccgctcagctgcgaagccagacgcacgttctgaccgttacggccaatcgcctgcgccaggttaccggcttcaacggcgatatccatggtgtgtttatcttcatccaccacgatagaagcaacgtctgctggtgccattgcgttaatcacgaactgcgccgggttatcatcccacaggacaatatcgatacgctctccgcccagttcagtagaaaccgcctgaacacgcgcgccacgcatacctacgcaagcacctaccggatcgatacgtttatcgttggttttcaccgcaattttcgcacgagatcccgggtcgcgagccgctgctttaatttcaatcacttcttcgccgatttccggcacttcaatacggaacagttcgatcagcatttccggcttggagcgggtgacgaacagctgcgcgccacgcgcttccgggcgaacggaatagagcacgccacgaacgcggtcaccagggcggaagttttcacgcggcagcatatcttcgcgcaggatcacggcttcagcgttgttgcccagatccagagagatgttgtcgcggtttacttttttcaccacgccggtgatgatttcaccttcgtgttcacggaactgatcaaccaccatcgcacgttcggcttcacgcactttctgcacgataacctgttttgccgtctgggtagtgatacggtcaaaggtaacagactcaatctgatcttcaacgtaatcgcccaggttcaggctttcatcttcataacgtgcggcttcaagggtgatttccttggtcggctgggtgacttcatcaacaactaaccagcgacggaaggtgtcaaaatcaccgcttttgcgatcgatctgtacgcgaacgtcgatttcttgttcatattttttctttgttgctgtcgccagcgcgctttccaatgcttcgaaaatcttctcgcgaggtagcgccttttcattggatacggcttcaactacagccaaaatttctttgttcatcgcgggcttttcacctcatccagactattaaaagtggggaaccaggttcgccttctggatattactcagcgcgaacacttcatctttaccttcgacggtaactgtgatcatttcaccgtctaccgctttgataacgccctgccatttacgacggttttgtaccgccatacggagaaccagagtcacctcttctccgacaaaacgggcgtagtgttcagccgtgaacagtgggcgatcgagacccggtgaggagacttccaggttataagcaacggtgatggggtcttcaacatccagcacagcacttacctggtggctcacatcagcacaatcatcaacattgatgccatcttcactatcaatatagatgcgcagtgtggatgtgcgaccgcgaataaattcgatgccaaccagttcaaaacccagggcctcaactggcgcagtaatcatctctgttaatttttgctctaatgtggacaagcccacccccaagacataaaaaaagggcctaaagcccagttattctgtagtcagataacaaaaaaccccgataaatcggggctttatataactgaaccctataaccgcaactgcggtctggagcactttccagaaggattttttcaaatcccactacgaaggccgaagtcttcacagtatatttgaaaaaggactctaagggaaagtggttgcgggggccggatttgaaccgacgaccttcgggttatgagcccgacgagctaccaggctgctccaccccgcgcctgaaacgtggcaaattctactcgttttgggtaaaaaatgcaaatactgctgggatttggtgtaccgagacgggacgtaaaatctgcaggcattatagtgatccacgccacattttgtcaacgtttattgctaatcacgtgaatgaatatccagttcactttcatttgttgaatacttttaccttctcctgctttcccttaagcgcattattttacaaaaaacacactaaactcttcctgtctccgataaaagatgattaaatgaaaactcatttattttgcataaaaattcagtgaaagcagaaatccaggctcatcatcagttaattaagcagggtgttattttatgacgacgattctcaagcatctcccggtaggtcaacgtattggtatcgctttttccggcggtctggacaccagtgccgcactgctgtggatgcgacaaaagggagcggttccttatgcatatactgcaaacctgggccagccagacgaagaggattatgatgcgatccctcgtcgtgccatggaatacggcgcggagaacgcacgtctgatcgactgccgcaaacaactggtggccgaaggtattgccgctattcagtgtggcgcatttcataacaccactggtggactgacctatttcaacacgacgccgctgggccgcgccgtgaccggcaccatgctggttgctgctatgaaagaagatggcgtgaatatctggggtgacggcagcacctataaaggaaacgatatcgaacgtttctaccgttacggtctgctgaccaatgctgaactgcagatttacaaaccgtggcttgatactgactttattgatgaactgggtggccgtcatgagatgtctgaatttatgattgcctgcggtttcgactacaaaatgtctgtcgaaaaagcttactccacggactccaacatgcttggtgcaacgcatgaagcgaaggatctggaatacctcaactccagcgtcaaaatcgtcaacccaattatgggcgtgaagttttgggatgagagcgtgaaaatcccggcagaagaagtcacagtacgctttgagcaaggtcatccggtggcgctgaacggtaaaacctttagcgacgacgtagaaatgatgctggaagctaaccgcatcggcggtcgtcacggcctgggcatgagcgaccagattgaaaaccgtatcatcgaagcaaaaagccgcggcatttatgaagcccctgggatggcactgctgcacattgcgtatgaacgtttgttgaccggtattcacaacgaagacaccattgagcagtatcacgcgcatggtcgtcagttgggccgtctgctgtaccagggacgttggtttgattcccaggcgctgatgctgcgtgactctctgcaacgctgggttgccagccagatcactggtgaagttactctggagctgcgccgcgggaacgattattcaatcctgaataccgtctcagagaacctgacctacaaaccagagcgtctgacgatggaaaaaggcgactcggtgttctcgccagatgatcgtatcggtcaactgaccatgcgtaacctggatatcaccgatacccgcgagaaacttttcggttatgccaaaactggcctgctctcctcctctgccgcttcaggggtgccgcaggtggagaatctggaaaataaaggccagtaattcgacatcaaccctgcccttcaggggtggggttaccttgattatcctctgtaaactcctttctgagcatcacataatcgaaaacatcatggtttgcatccacaacccgtgagtctcctttatagtgtgcaatcacttcctcaagcgtttgcggctgttccggctttgttacccccatccacgcattaataaggtaattattgtaagctgtcgaaaagatgttgttttccgttgtgcgatccacgccatcccctagaacgggactataccagataaacatcgggacatgatacgcctgctggctagcctccctgcctccatgaaaatagacgttcttcttcgtagggtcgcgttccaggccgtggtcggcaaaatacatgaccgaggcgcggcgatcttttaataattcaaaaacctgacctagcaaactatctgtgtaatgaatggagttgtcatagcaggcatcctgatcgtcctgcggttgaaacacagcgctggattgcggataggcgctacaagccggttcatggcttccatttaaatgaagaacaatcagtttcttttgctgcgtcttttgctgtaacgcttgcgataaatgaggcaacaacaattcatcaaatcctctgacatagactgtttccatggcgcgcatggcgatactggtaactgctgtaccattctgccgaaaagcggattgcgagcttagccagaaagtctgaaatcctgcttgattagccatattaataatgttgtccgggtaattatgaatgtcatgactcaaaacagaatcagcagttaaagaaaggggaaccgacagcgcagtgtaaggtgcaccgcttattgcttgattaaacagtttgatctgttttctttgtgcttcgacttgcggtgtcgtagagcgtgtatatccatacaaagacatattgtcgacacgtacagactcccccacaatcaacacgtaggtatcaatacctgtatccctgactgataattgaaaacacggcaccgtgtttgcaattgagagtaatctttgatgctctttcgctgctaaagcaaaataattgagattgaaaaacggtgtataggtagcaaatcgcgacgctagtatatatggactgaacgcttttttattttttgcatctttataagcaaattgacaagcggaaaataaactgcccgaaatgacaatcagcaataatattcctgtcacttttttcgtcggcaaggaaacatcatattttattattactgccaaaaaaagaagggataaaaaggcaaaagcacatagataagggatatacatccccagcattttgacaacttcatccggatcactctgcagcacactaatcgcaaatccatcattgaaagctgtaccaaaggtacaccatgaatagaggctaatactcatgtctgccgctgtcagtaacacaaatggtgtggcaacaagcaggcgaagcggaagggatgatatacgtttaacaaccaggatggtcagaacgaaaaacagcaatcgctgaaccatatgcgctccggaagaggcgactaagttcgtaataccaaaaacaataacacaaagatacaacaaccaatgagatttaaaacttctaacaaatttgttgaatactgtcatccagaaatccaagttcacaaccaatataaacaattatcaacaatgttcaattttatatcagacatgtttttcaactctgatccatatcagaccgaaacactgttagttttttctttttaaatgatgcggccattgttctcagtaattaaataacattatcaatgcgtctctaaacattacgcagaacgtagccatcagtagttatactgacaggagcaggatggtttatcgagaagtaaacatatccgtattcgtaccggaactggagttgacacaataaagtgccaattatgtcagcagaagggaaaagtttataactaaggcgtaccggcaccatcgtttcaaagtaccagctacgagtaaagcaactggacgagatacagatacctgacaaccattcctcagaccaggaccaaaacgaaaaaagacgcttttcagcgtctcttttctggaatttggtaccgaggacgggacttgaacccgtaagccctattgggcactaccacctcaaggtagcgtgtctaccaattccaccacctcggcacggatactactttttagttcgggatatcgctggtcggcttagccggagcagctggctgagtttgttcggttttcgccggcgcactcaggttttcccattcgctacctttattggttttattgctattgatgttacccagcaccagactgatgatgaagaataacgttgccagcagcgccgtcatgcgggtcatgaagttaccagaaccacttgaaccaaacagcgtagcggaagcgcctgctccgaaggaggctcccatatcagcgcctttaccttgctgcagcatgatcagaccaacaaggccaattgccacaataaggaaaactactaaaagagcttcgtacataatcaacctgttccttgcggagttgccgcgtaccaatgcttcaaccaataaagcgggagtttttaatctttcccactgaagcgggtgtgaatactaaccaaagcgaatgaccttcgcaagggcaattttattgcattgtatcaactgcggaaaaaaacagcaaaaccgatgtgttcgctgagaaaaaaggcgacaatcgccgcctttttagccagttatctaacgctttaaacggcttttactgcatcggcgatgcggtgtgcaaattcagtcacctgcgcttcgtcttcgccttccaccatcacgcgaattaacggttcggtgccggatttacgcaacagcacacgtccacggctacccagcgccgcttcaacttctgcggtcacagctttgactgattcatgctccagcggatcgccgctacctgcggtgtaacgcacgtttaccaggatttgcgggaacattttcatgccgctgcaaaggtcgtgcaggctcatatgattacgcgccatcgccgccagcacctgcaaaccagcaacgatgccgtcaccggtagtggttttatccagcaggatcacatgaccggaattctctgcaccgatacgccagcctttctcctgcattttttccagtacgtagcggtcacccactttcgcgcgctcaaatggaattcctaactgtttcagcgccagttcaagccccatgttgctcatcaatgtacccacagcgccaccacgcagctggccctgacgaagaccttcacgcgcgatgatatacatgatctgatcgccatcgactttattgccttcatggtcaaccataatcacgcgatcgccgtcgccgtcgaaggcaataccgagatccgctttttcagccagcacacgagcctggagcgcgcgaacgtcggtagcccccacttcggcattgatgtttacaccgttcggctcacaaccgatagcgataacgttcgctcccagttcacgcagcacgttcggcgcgatgtgataagtcgcaccgtttgcacaatccaccacaatcttcagttcactgaggctaagttcgtttgggaacgtggctttgcaaaactcgatatagcgacccgcagcatcaacgatacggctggctttacccagttctgccgaatcaacacagctgatctctttttccatttccgcttcgatggcctcttctactgcatccggtagtttggtgccgtcgatagagaaaaatttaatgccattatcgtagaacgggttatgcgatgcagatatcacaattccggcctctgcgcggaaggtacgcgtcagataagccacggccggtgttggcatcggaccagtgaagagtgcggaaaggcccgcagccgccagacccgcttccagtgctgactccagcatgtagccagaaatacgcgtgtctttaccaatgatgatcttacgggagccgtggcgcgccagcactttacccgcggcccaacccagcttaagcacaaaatcaggggtgatcggcgcatcccctacacgaccacgaatcccatcggtaccgaaatatttacgattactcatagcgtttgttttcctttgcagacagagtggcttccaccacccgcatcgcttctacggtttctttgacgtcatgaacacgaatgatatgcgcgccttgcatagcggcaatgaccgcacaagccagactaccgctcagacgctcggacggccccacgttcagcagctgcccaatcatcgattttcgtgacatacccaccaacagcggcaggttgaaatggtgaaattcagccaggcgcgccagtaatgaatagttatgggagagatttttaccgaaaccgaatccggggtcgagcaacaatttctcttttgcgatacccgcctgctcgcaacgtgctatttgctcaataaaatagcgattaacttctgcaaagacatcgtcatacttcggggcttcctgcatggtctttggatttccctgcatatgcatcagacaaaccggtaaaccggtttctgcagctgcctccagagcccctggttcggaaagggagcggatatcgttaataatgtgagcgccaactttcgctgactcacggatgacttctggtttggatgtatcgaccgagatccagacttcgaagcgttgagcaattgcctcaaccacaggaataacacgttgcaactcttcttcaacgctaacttccgccgctcctgggcgcgtggactcgccaccaacgtcaatgatcgtcgcgccagcgttgatcatcagattcgcatgtttcaccgcatctatcagcgagttatgcgtaccgccatccgaaaaggaatcaggcgtgacgttgaggatccccattacgtgaggatggctaaggtccagtgaagtgccctgggcaaagagtttcatggtgttatccctggtatgaattgataagaaaaaaccccggagcacgccccggggttttcggtacaaatacagtcatctgatgcgggaacttatttgtcgcctaactgctctgacatggtgttacccgggttcggcgtacgcggttcatcaaccggacgaggagcctttggactaccattgtcgccagaattgttagaagcgcctggttcttcccagcccgctggcggacgtacatcgcgacgtgccatcaggtcatcaatctgcggtgcgtcgatagtctcatatttcatgagagcatctttcatcgcatgcagaatatccatattgtcggtcagaagctgacgcgcacgattatagttacgctcaatcagtgctttcacttcctggtcgatgatacgtgcagtttcatcggacatatgtttcgctttcgctacgctacggccgaggaacacttcaccttcttcttccgcgtacagcagtggacccaatttctcagagaagccccactgagtcaccatgttacgtgccaggttggtcgcaactttaatatcgttggacgcaccggtagaaacatgttccggcccgtagatgatctcttccgccagacgaccaccgtacagcgtagaaatctggctttccagtttctgacggctggcgctgattgcgtcgccctcaggcaagaagaaagtcacacccagcgcacgaccgcgtgggataatcgtcactttgtgcaccggatcgtgttccggcaccaggcgaccgataattgcgtgacccgcttcgtggtaagccgtcgattctttctgcgcttccgtcatcaccatggagcgacgttccgcacccatcatgattttgtctttcgctttctcgaactcaaccatcgacacaacgcgtttgttgccacgagcagcgaacagtgccgcttcgttcaccaagttcgccaggtcagcaccggagaaaccaggagtaccacgggcaatgattgccgcgtcgatatcgggtgccaatggtacgcgacgcatgtgaaccttcaggatctgctcacgaccgcgaacatctggcaagccaaccacaacctgacggtcgaaacggccaggacgcagcagcgctgggtcgagaacgtccggacggttagtcgcggcgataacgatgataccttcgttaccttcgaagccatccatctcaaccagcatctggttcagagtctgttcacgttcatcgtgaccaccgcccagacctgcgccacgctggcggcctacggcgtcgatttcatcgataaagatgatgcacggtgccgctttcttcgcctgttcgaacatgtcacgaacacgggatgcacccacaccgacgaacatttctacgaagtcagaaccggagatagtaaagaacggaactttcgcttcgcctgcaatcgctttcgccagcagcgttttaccggtacccggaggaccgaccatcaggacgcctttcgggatcttaccgccgagtttctggaagcggctcggctcgcgcagatactcaaccagttcagcaacttcttcttttgcttcgtcgcagcccgcaacgtcagcaaaggtcgttttgatctgatcttcagtcagcatgcgcgctttgctcttaccaaacgacatggcacctttgccaccgccgccctgcatttgacgcatgaagaagatccagacaccaatcagcaacaacatcgggaaccaggagatgaagatagaagccagcaggcttggttcttcaggcggttcaccgacaaccttgacgttcttggtcaacaggttatccagtaatttcggatcctgaaccggaatgtaagtggtataacggttactatctttcttggtaacgttgatttcacgtccgttgatacgcgcttcacgaacctggtcgttattgacctcttgtaggaaggtagagtaatccaccttacggccattagactcgctgggcccaaagctctggaatactgacatcagcacaacggcaatgaccagccagagtattaggtttttcgccatgtcactcaagggattaacctcttattacaactgtgttaaaaacagcgtcaggatactctatatccagcatctttcaaactttcgtctgaaatctcccggttagggtttacgcccggtcgctacaatatacacttcccgcgaacgtgcacgagaagagtccggcttacgaactttgaccttcgtaaacagggagcgaatttcccttagatactcatcgaaaccttcgccctggaacaccttcactacaaaactgccacctggcgctaatacatcacgacacatttctagcgccagttccaccagatacatggcacgggggatatccaccgccggtgttccgctcatgtttggtgccatatcggacatgacaacctggactttgctgtcgccaacgcgctccagcagtgctttcatcaccagttcatcacgaaaatcgccctgaagaaagtccacaccaacgataggatccataggtaaaagatcgcaagcgatgatgcggcctttgccgccaatttgggtgaccacatattgtgaccaaccacccggagcagcaccaaggtcgacaaccgtcattcccggtttaaagagtttgtcactttgctgtatttcatcaagtttaaaccaggcacgggaacgtaacccctttttctgtgcctgttgaacatatttatcgctaaagtgttcctgaagccagcggctggagctggcagaacgcttcttacctgtcatttaactttcccatggggataactcatcgtaaccaattgcgtaaatttttacgcgcctatttggtgatatatgggagatggcggtagaatgacccgttttcaatcccaacgtaagcaaaaaatacgatgaatctgagtactaaacaaaaacagcacctgaaaggtctggcacatccgctcaagccagttgttctgcttggcagtaatggtttgaccgaaggggtgctggccgagattgaacaagcgttagagcaccatgaactcatcaaggtgaaaatcgccaccgaagatcgcgaaactaaaaccttgatcgtggaagctatcgtgcgcgaaaccggcgcctgtaatgtacaggtcatcggtaaaacgctggtgctttatcgcccaactaaagaacgtaaaatctcgctgccacgctaagattatcctaaagttacacacattcgctgtgtaaaacgaggggttttccgcaggcaggagagcaaaatgccacgctctgttcgttgataaaaggccgcatagcggcctttttcctttctttacaatacatcaacatcttgagtattgggtaattcttacaggtattccaccttaattacttcaaattctacttcgccgcccggcgttttgatgaccacaacatcatcttcttctttgccgatcaggccacgagcaataggcgagtttacggaaatcaggttttgtttaaagtcagcttcgtcatcgccaacgatgcgataagtctgttcttcgtcagaatcgagattcagcaccgttacggtagcaccaaaaataacgcgcccattgttgggcattttggtgacatcaatcacctgcgcgttcgacagcttggcttcgatgtctttgatacggccttcgcaaaagccctgctgttcacgagctgcgtggtattcggcgttttctttcaagtcgccatgctcacgcgcttccgcgatagcagcaatgatttcaggacggcgcacagatttcagaaaatccagctcttcgcgtaatttttcagcgccgcgtaaggtcatcggaatagcttgcatttgttatacctcttgaatattcctgatggggcaagtcttcacccaccccggctgttcggcctgcccggcataactcctcaccgggaccagaagcaaaaaaataccgacccgggtacaagtcccaggtcagctacaattcacattttgatagtcattttaccctgaagttcccgaagggtcatcgtttactttatagggcgttgcgccgtagtatgacggctcgattccaggttgttagcgcgagattatgcgattttccagatttatcatcggattgaccagctgtatagcgttcagtgttcaggccgcaaatgttgatgagtacattactcaactccccgctggtgccaaccttgccctgatggtgcaaaaagtcggcgcgtcggcccccgctattgattaccacagtcagcagatggcgctgcccgccagtacgcagaaagtgattactgcactggcggcgttgattcaactcggccccgattttcgttttaccacgacgcttgaaaccaaaggcaatgtggaaaacggcgtacttaagggtgacttagtggcgcgatttggtgccgatccgacgttaagacgtcaggatattcgcaatatggtcgcgactttgaaaaaatctggcgtcaaccaaatcgatggcaatgtgttgatagatacctccattttcgccagccacgataaagcccccggctggccatggaatgacatgacacaatgctttagcgctccgcctgccgccgccatagttgaccgcaactgtttctccgtctcgctctacagtgccccaaaacctggtgatatggcttttatacgcgtggcatcttattaccccgttacgatgttcagccaggtacgcaccctcccccgtggttctgccgaagcgcaatactgcgagctggatgtggtgccaggcgacctgaaccgctttacgctgaccggatgcctgccacaacgttctgagccgctcccgttggcttttgccgtgcaggatggagccagctatgccggtgcaattctgaaagatgagttaaaacaggcaggtatcacctggagcggaacactgctgcgccagactcaggttaacgaacctggaacggtagttgccagtaaacagtcggccccgctgcacgatctgcttaagattatgctgaaaaagtcggacaacatgatcgccgatacggttttccgcatgataggccatgcgcgcttcaatgtgcctggaacatggcgggccgggtcggacgccgtgcgtcagatcctgcgccagcaagtcggtgtcgatattggaaacaccattattgccgatggttcagggctttcgcggcataacctgattgcccccgccaccatgatgcaggtgctgcaatacattgcccaacacgacaatgaacttaactttatctccatgctgccgctggcgggctatgacggctctttgcagtaccgtgcaggtctgcatcaggcgggcgtggatggaaaagtctcagcgaaaaccggttcgttgcagggggtatataacctggcgggattcattaccacagcgagcgggcaacgaatggcgtttgtgcaatatctttctggctatgcagtagaaccggcggatcagcgtaatcgccgtattccgttggtacgttttgaaagccgtttgtataaagatatttaccagaacaattagtctaaagagaaaccccggcacatggccggggttttgctgattaacgcttgtaaatgaactcaacgccttcttcgtcgtcttcgtcccagtcgtcatcccagtcttcatcatcctcttcagcaatctcttcaagctgctggcgatgataatcatcccacatgaattcgactttctctggctgtttcgcttcttcagcctgcacgaccgggttttcaatgataaaggtcatcacatcccagcagagatctttcacgcccagtccgctcgccgcagagatcagataatatttatcttcccaacccagcgcctcagcgatcgctttcgctttctcttcggcttctgccttatccagcaggtcgatcttgttgaagactaaccaacgcggtttcgccgccagatcctggctgtatttttccagctcgctgataataatacgcgcgttttcaaccggatcggtgccatcaatcggatcgatatcgatgaggtgcaacaggacgcggcaacgctccaggtgcttcaggaagcgaatgcccagaccagcgccttctgcagcgccttcaatcagtcctggaatatcggcaacaacgaagctcttttcgttgtccattcgtaccacaccaagacttggcaccagagtggtaaacggataatccgccactttcggtttagccgccgatactgcgcggataaatgtcgatttacccgcgtttggcatccccagcataccgacgtcagccagcagcatcagctccagtagcagctcacgcttatcgcccggcgtaccgttagttttctgccgtggtgtacggttaactgacgatttgaaacgggtattgcccagaccgtgccagccgcccttagcaaccagcagacgctgaccgtgtttggtcatatcgcccatggtttcaccggtaccctggtcgataacacgcgtacctacaggcactttaatcgtcacgtctttaccgcgcttaccggtacagtcgcggcttgcgccattctgaccacgctctgcgcggaaagatttttcaaaacgataatcgataagcgtgttcaggttctcgtcggcttccatccatacgtcaccgccgtcaccgccgtcgccgccatccgggccgcctttcggaatatacttttcgcggcggaagctcacgcaaccattaccgccatcacctgcaacgaccagaatcgatgcttcatcaacaaacttcattttattctccgtaaatcattcgcctgcgcggggttgcgataccaccgttgtatgcttacgtaatccgccccaaatacgatgaccaatggcggaatacatcgcgcccgcaaccacgacaaacgcaccgagataacctaaaaggtttaacatcggtctggcgaagaaatcgggccaggccagtgataaaagatctgaaaaaaacagcgtaaacagtggggtgagcgtgatgatcgcgctcacctgcgctgcctgccagcgagccatcgcttccgccagggcgccatatcctaccaatgtattcagtccgcaaaaaattaaacatgcgagctgccagtggctaagctgcgctatcactccaggatttgccagagggaagagcgcaattgtacataaagtgtacaacaaaaacaggatctgcggtgaagccagccgacgcaataaaaccttttgcgccacgccataactcacccaaaccgtcgccgcaccgaccccaaagataactccccaggtgtaatcggtgagctttgtaaatatctcgaccagactggtgttaaaaaacatcaccaggccgctcaggagcatcaatgcccctacaacctgagtactgcgcattttctctttcaggataaatacgctggcaaccatcatgccaactggcgagagttgcccaatcacctgcgaagcggtcggactcaggtattgcaaggatgagctgaacaggatgaagttcccaaacagcccggcggtcgccactgctaacaaaatcaaccagcgtggcttacgaaacacgcgtaatggcggcaaccgcttcttcaccgcaagaatggcaccaaggccaatactcgccatcaagaaacggtaaaacacgattgtcggaggttccatcacctccagcacctgcttcattgcgattggcaacgccccccagcaaattgctgtggtgagcgccaaaagaatgccaatgcctgcctgctgcttcataccgtattccctgcaaagcgcatatgcggattaacgtcgcaccatgcgcatttttaccggttatcgaatgtaaaaagccccgcaacgtgttgcggggctttcatccgttaccgggacgcgaaaaacttattcagcttcgatgctgataaatttacggtttttcgggcctttaacttcgaatttcactttaccgtctgctttagcaaacagagtgtggtcacgaccgcaacctacgttagcgccagcgtggaatttggtaccacgttgacgaacgatgatgctacccgccagaacggattcgccaccgaaacgcttaacgcccaggcgtttagcttctgaatcgcgaccgttacgtgtggagccgccagcctttttatgtgccatttgaaatctctcctcaggtcttaggcgctgatgccagtaattttcacatcagtgaaccactgacgatggccctgctgcttacgatagtgtttacgacgacgaaacttaacgattttaactttctcgccacgaccgtgagcaacaacttcagctttgattacgccgccatcaacgaaaggaacgccgattttgacttcttcaccgtttgcgatcatcagcacttcagcgaactcaacagtttcgccagttgcgatgtccagcttttccaggcgaacggtctgaccttcgcttactcggtgttgtttaccaccactttggaaaaccgcgtacatataaaactccgcttccgcgcacaccttttcaatgattcagagtgcgctataaatattcacaatagggcgcgaatattacgcaaaacgcacgcctttgacaagtgctacagtcaatacacgaagaaaaaaaacacaacttgtacggtaacgtttatctgtgccattttttcagtacaatcaccctatattcctaaccataaaccctaagttgcctttgttcacagtaaggtaatcggggcgaaaagcccggcttttgcgatgaatttagaaaaaatcaatgagttaaccgcgcaagatatggcgggtgttaatgcggcaatccttgagcagcttaattccgacgtccaactgatcaatcagttaggctattacatcgtcagcggcggcggtaaacgtattcgtccgatgattgctgtactggctgcacgagctgttggctatgagggaaatgcgcatgtcaccattgctgccctgatcgagtttatccacacggcgactctgctacacgacgacgttgtggatgaatcagatatgcgcaggggtaaagctaccgccaacgccgcatttggcaatgccgccagcgtgctggtaggcgattttatttatacccgcgcgttccagatgatgaccagcctcggttcactcaaagtgctggaagtcatgtcagaagccgtaaacgtcatcgcagaaggtgaagttctgcaactgatgaacgttaacgatccggacatcactgaagaaaactacatgcgcgttatctacagcaagactgcgcgtctgtttgaggctgccgcgcagtgttccgggattctggctggctgtacgccggaggaggaaaaaggcctacaggattatgggcgctatctcggcactgctttccagttgatcgacgatttactcgattacaatgccgatggcgaacagttaggtaaaaacgtcggcgacgatctgaacgaaggtaaaccgacgctgccgctgctgcatgcgatgcatcatggcacaccagaacaggcacagatgattcgtaccgccatcgaacagggtaacggtcgccatcttctggaaccggttctggaagcaatgaacgcttgtggatctcttgaatggacgcgtcagcgtgccgaggaagaagcagacaaagccatcgcagcgttacaggtgctcccggacaccccgtggagagaagcactcgtcggcctcgcgcacatcgctgttcaacgcgatcgttaatcccctcccctcatcccgcgcagtgcgcgggatgattccagtaaattccataaaaacacttattcagctctataactcctgaaaaacggggctgtgtatctttatatattctgaatattcacactctttacaggaattttttagagcaacaggccatcaggagtatagtgatgctcgacagaaacagaagaagtgttctgaatgaaagcgactaacttaaggagtgaggaaagatggaaagtaatttcattgactggcatcccgctgacatcattgcaggtttgcgcaagaagggaacgtcaatggcggcggagtctcgcagaaatggtttgagttcctcaacgctggcgaacgcattatcacgcccatggccgaaaggagagatgattattgcgaaagccctgggaactgacccctgggttatctggccatcacgctaccatgatccgcagacccatgagtttatcgacagaacgcagttgatgcgtagctacactaaaccgaaaaaatgagtggcctggcggtagccccgcgaacggggctgccagctctcagacaattactcgcctttcacacgctcaatatttgcacctaaagcgcgtagtttgtcttcaatgcgttcgtagccacgatcgatgtgataaatacgatcaaccaccgtcgtcccttccgcaatacagccagccagcaccaggcttgctgatgcacgcagatcggttgccataacctgtgcgccagaaagtttttcaacaccgtgacaaataacggtattgctttcgatttcggcgtgcgcgcccatacgactcagctctggcacatgcataaagcggttttcaaagaccgtttcggtgatgaatccggtcccttctgccaccagattcaacagcgtgaactgggcctgcatatcggtagggaatgccggatgcggcgcggtacgtacgttaacagccttcggacgtttgccatgcatatccaggctaatccagtcttcgccgacttcgatgtccgctccagcgtcacgcagtttcgccagcacggcgtccagagtatctggctgcgcgttacggcagataattttgccgcgagagatcgccgccgccaccaggaaagtaccggtttcgatacgatccggcagcacgcgatagacaccgccgcctaaacgttccacaccttcgatgacgatacgatcggtgccctgaccgctaattttcgcacccagcgtaatcaggaagttcgcggtatcgacgatttccggttcacgcgctgcgttttcaataatcgtggtgccttccgcaagggttgcagcacacatgatggtcaccgttgcgccaacgctgactttatccatcacgatatgtgcgcctttcaaacgaccatcgacggaagctttaacgtaaccttcttccagtttgatggtcgcgcctaattgttcgaggccagaaatgtgtagatcaaccggacgtgcgccgatcgtacaaccgccaggcagtgaaacttgcccctgaccaaagcgcgctaccagcggccccagcgcccagatagaagcacgcatggttttaaccagatcgtaaggtgcgcagaatacattaacgtcgcgggcatcaatatgcacagaaccattacgttctactttcgcacccagctggcttagcagcttcattgatgtatcgacgtcttttagtttcgggacgttctggatctctaccggttcttccgccagtagtgcggcaaaaaggataggcagagcagcatttttagcgccggaaattgtgacttcgccctggagcttcgttggcccctgaacacgaaatttatccatttagtttgttctcagttaacaattcatatccgctaccggcgaatcgcccatagctcaaaagccgttcagtttgcgatcgcgcgcccactccgcaggggtatacgctttgatcgacacagcatgaatgcggttatccgcaatatattccatcagcgggccatagaccgtctgctgttttttaacccgactcatgccgtcaaacaactcacccacggcaataacctgaaagtggctgccatcgccggaaacgtggacttcctggagggagagagcgttcatcaacacgctctgaatttcattattttccatgggatcttcaatcatcagttaataaatcagcgaaacatcttagagcaaagttgcgctggcataaataagcaaaaagcctcgctgataaatcagacaaggctcgacttgcaggcaggtttgccggacaggcggttaacgccatatccggcctgaaaaaatttaacgaggcagaacatcagcaggcaaattatacaatttcgccagggtatacactttgtcgtttaccccctgaagcgtcacattgttgccctgctttttcgccagatcgataagatggagcagcagtgccagtccacccgtatccacgcgagacacacggctaagatcgatgctggtaatccccttcaccgcttcctcacgtatttcccaaagcggtagcagaacgtcctgatccagctctccggataacgccagcgtgtcacccgtctgcatccagctcagtgactcgctcattattttttctcttccagagtgattttctgttgagaaatcgatttcagttgcgcagtcaggccgtcgatacctttggtacgcagcagcgttccccactcgttttgtttggtggtgatcatactgacgccttcagcaatcatgtcgtaagcctgccagttgcccgtctgggagtttttacgccactggaagtccagacgcaccggcgggcggccattcgggtcaataatggtaacgcgaatcggcacaatggttttatcacccagcggctgttctggcgcaatctgataggtttgaccgtgatacatcgccagcgcctgaccgtaagcctgcttcaggtactcacggaaagcggcaaagtaagcatcacgttgagctggggtcgcactcttgtaatactggcccagcaccagcgcaccggcgtatttcacctgtacgtatggcaacagttcctgatcaacaatggtacgcagataatccgggttagcccgaatttgcggttgctcattcttcaggcgatcgaacgttttctgcgccgcctcgtccatcagcttatacggattggtctggtctgccgcggttgccgcactcagcggtgcaatcaccagcaaagcgaccatcattaaacgtttaaacatgcgtcggttctcctgaaattatttcgttgtacccacaggttcagtggtttcattattacctggcgcagcagctggcgcatcgccactattcttattgtcatcgcctttactaccgtaaaggaactgaccaatgagatcttccagcaccatcgcagacttggtgtcctgaattgtatcgccatccttcaggatagcagttcccagttccgggtcttcaaaaccgacgtttaatgccagatattgttcccccagcaggccggaagtacgaatgctcagcgaactggtatcaggaatgtggttataacgttgttcaatttccagcgttacgcgcggcagataggttttcgggtccagcgtaatatccgccacccggcccacaacaacgccaccaatgctgaccggagagcgggctttcaggccgccaatgttatcgaacgtcgcataaagcgtataggtcggttcagtacgtatagacgtcacgttcgctgccttcaggcaaacaaacagcgccgcaagcagtgctgctaataaaaagatacccacccaaatttcattttttttcgtttgcatgaactcaattcccaaacatcaatgcggtcagcacaaaatccagccccagaacagccagagacgagtggacaacggtgcgagtggttgcccggctaatcccggcagacgtcgggatggcgtcgtagccgttaaacaacgaaatccacgtcaccgtgatggcgaacaccacgctcttaatcagacagttgacgagatccatacgccagtcgacggcattttgcattgccgaccagaagaacccactatcaatgcctttccaactgacgccgaccagcgatccgccccagatccccacggcgacgaagataaccgtcaacagtggtaatgaaataactccagcccagaaacggggagaaataacccgacgcagcggatccaccgccatcatctccatactggagagttgctctgtagcgcgcatcaggccgatttctgcggttagcgccgaaccagcacgcccggcaaacaacaacgcggcaaccaccggccccagttcacgcagtagcgataacgccaccagcatacccagactggtttccgcactataagtggtcagaaccagataaccttgcagccccaacaccattccgatgaacacgccagaaacaacaataatcagcatcgacaggacgccgacattatagagctggcgcaccagcagcggtgcatgtttgcgaaattccggtttgccgaccagcgcattgaataacattaacccggcccgcccgaacgttctcagggttttaatccctttatgtccgagcgacgccagcgcatttaacagcatgagtggcttaactccctggtaaaagatcagcgtgataatcgccggcaggatagcggaacggaacaggcccgtcagctatcccgtccagaaactgacgtacgcgcggatcaggattcgcctgcaacgcctgggcactgccatgagcgacaatttttttgtccgccaggatccaggcgtgatccgcaatacttaacacttccggcacatcgtgagaaaccaccacacaagtcacgcccagcgcgctgttcagctcagaaatcagcttcaccagcacgcccatggtaatgggatcttgcccaacaaagggctcatcaaacatgatgagatccggctccagcgcaatcgcacgtgccagcgctgcacgccgcgccatcccaccggaaagttcagaaggcataagtttagccgctccacgcagccccacggcctccagcttcatcatcaccgtactatgcaacaatggcgcgggaagttgggtatgttcccgcagtggataggcgacgttgtcaaatacgttcatatcagtgaacaacgccccggactgaaataacatgctcatccgtttgcgcactgtatacaggcgcgaacgagacatcgccggaatattctcaccatcgaaaaggatctcaccatgatctggtgcgatttgcccgccaatcagacggagtagcgtcgttttaccgatgcccgatggccccatgatcgccgtgatcttccctcgcggcacggtcagggaaatattatcgaagatgcagcgattgccacgcgtaaaactgacatcgcgcatatcgactaaattcgccacagactgctccataattcacccttcgtcttgcgttgattttctaagcatggcgctcaatttaaccttgaacccaacatatttacagaatattacctgccgtggttagcgaaagctggcatttgttttactttttagccgcataaagtcaaaattaagaatctgttacggctttctgaaaatcttcagcggaccggcgagtatacctgaagaaaggacgttagatgcttttagctacggcactgttaattgttggtttacttttggtcgtttacagtgccgaccgcctggtttttgccgcgtctattctttgccgaacctttggcatcccgccgttgatcatcggcatgacggtggtcagtattggtacatcgttaccagaaatcatcgtctcgcttgccgcgtctttgcacgaacaacgcgatttagccgttggtacagccctcggctcaaacattatcaatatattgctgatcctcggtctggctgcgctggttcgtccttttaccgtccattctgatgttctacgccgtgaattacccttaatgttgttggtcagcgtggtggccggttccgtactctatgacggacaacttagtcgcagcgatggtatctttctcctctttctggctgtgctatggctgctgttcattgttaaacttgcacgtcaggctgaacgtcaggggactgacagcctgaccagagagcagcttgcagagctgccgcgtgaaggtggattgcccgtcgcatttttatggctcggcatcgcactgatcattatgccagtggccacgcggatggtagttgataacgccacggtgctggcgaattactttgccatcagcgagttgacgatgggtctgacggcaattgctatcggaaccagcctgccggaactggcaaccgcaatagcgggggttcgcaaaggtgaaaacgacattgcggtcggaaatatcattggcgcaaacatttttattattgtcatcgtgttgggtttacccgcgctgataacgccaggagagattgatccactggcgtacagtcgtgactacagcgtgatgttgctggtgagcattatttttgcgttgctgtgctggcggcgctccccgcaaccgggccgtggtgtaggggtattattaactggcggatttatcgtatggctggcgatgttgtactggttatcgccaatactcgttgaataactggaaacgcattatgtcgcacgtagagttacaaccgggttttgactttcagcaagcaggtaaagaagtcctggcgattgaacgtgaatgcctggcggagcttgatcaatacatcaatcagaatttcacgcttgcctgtgaaaagatgttctggtgtaaagggaaagttgtcgtcatgggaatgggcaaatcggggcacatcgggcgcaaaatggcagcaacatttgccagcaccggtacaccttcatttttcgtccatcctggcgaagccgcgcatggtgatttaggcatggtcaccccacaggatgtggtgattgctatctctaactcaggtgaatccagcgaaatcacggccttaattccagtgcttaagcgtcttcacgtaccgttaatctgcatcaccggtcgcccggagagcagcatggcgcgcgccgcagatgtgcatctgtgtgttaaagtggcgaaagaagcctgtccgttagggctggcaccgaccagcagcacaaccgccacgctggttatgggcgatgccctcgctgtcgcgctgttaaaagcacgcggctttactgctgaagattttgcgctctcacacccaggcggcgcactgggtcgtaaacttctgctgcgcgtaaacgatattatgcatacgggcgatgagatcccgcatgttaagaaaacggccagtctgcgtgacgcattgctggaagttacccgcaaaaatcttggtatgactgtcatttgcgatgacaatatgatgattgaaggcatctttaccgacggtgatttacgccgtgtcttcgatatgggcgtggatgttcgtcagttaagtattgccgatgtgatgacgccggggggaatacgcgtgcgcccaggcattctggccgttgaggcactgaacttaatgcagtcccgccatatcacctccgtgatggttgccgatggcgaccatttactcggtgtgttacatatgcatgatttactgcgtgcaggcgtagtgtaaagattcaaggataaacaacaatgagcaaagcaggtgcgtcgcttgcgacctgttacggccctgtcagcgccgacgttatggcaaaagcagagaacattcgtctgctgatcctcgacgttgatggcgtactgtcagatggcctgatttatatgggcaataacggcgaagagctgaaagcgttcaatgttcgtgacggttatggcattcgttgtgcgctcacctctgatattgaagtcgctatcattaccgggcgaaaggctaaactggtagaagatcgttgtgccacattggggatcactcacttgtatcaggggcagtcaaacaaactgatcgcctttagcgatctgctggaaaaactggcgattgccccggaaaatgtggcttatgtcggcgatgatctcatcgactggccggtaatggaaaaagtgggtttaagcgtcgccgtggccgatgcgcatccactgttgatcccgcgcgccgattacgtaacgcacattgctggcggtcgtggcgcagtgcgagaagtttgcgacttattactcctggcgcagggcaaactggatgaagccaaagggcaatcgatatgagtaaagccagacgttgggttatcattgtgctatcactggcggttctggtgatgatcggcattaatatggccgaaaaagacgataccgcccaggtggtcgtcaacaacaatgatcccacctataaaagcgagcatacggacacgctcgtctataacccagaaggggcactaagctatcgattgattgctcaacacgttgaatattattccgatcaggccgtttcgtggtttacgcagccggtacttaccacgtttgataaggataaaatcccgacatggtccgtaaaagcagataaagccaagctgaccaatgaccggatgctctatttatatggacacgttgaagtcaatgcactcgtgccggactctcaacttcgcagaatcacgacggataacgcgcagatcaatctggtgacgcaggatgttacctctgaagacctcgtcacgttatacggaacaacatttaactccagcggtctgaaaatgcgcggcaacttacgcagcaagaacgccgagctgattgaaaaggttagaacatcctatgaaattcaaaacaaacaaactcagccttaatcttgtgcttgccagctcacttctggccgccagcattccggcatttgccgtaaccggagacactgatcagccgatccacattgaatcggaccagcaatctcttgatatgcaaggcaacgtggttacctttaccggcaatgtcatcgtcacccagggcaccatcaaaattaatgccgacaaagtggtcgttacccgtccgggcggcgaacaaggtaaagaagtgattgacggctacggtaaaccggcaacgttctaccagatgcaggacaacggtaaacccgttgaaggtcacgcttcacagatgcactacgaactggcaaaagattttgtcgttctgacgggtaatgcttatctgcagcaggtcgatagcaacattaagggcgataagatcacttacctggtgaaagagcagaaaatgcaggctttcagcgacaaaggcaagcgcgtaaccaccgttctggtgccgtcgcagctgcaggacaaaaacaataaaggccagaccccggcacagaagaagggtaattaattcgttatggcaacattaactgcaaagaaccttgcaaaagcctataaaggccgtcgcgtggtagaagacgtcagcctgaccgtcaactccggggaaattgtcggtctgctggggccaaacggtgccggtaagaccaccactttctacatggttgttggcattgtgccgcgcgatgcgggcaacatcattattgatgatgacgatatcagtctgctgcctctgcatgcacgcgcgcgccgcggtatcggctatctgccgcaggaagcctccattttccgtcgcctcagcgtttacgataacctgatggcggtactgcaaattcgtgacgacttgtctgctgaacaacgtgaagaccgcgcgaacgagctgatggaagagtttcacattgagcacctgcgtgacagcatggggcagtcactctccgggggtgaacgtcgccgtgtagaaattgcccgcgcactggctgcgaatccgaaatttattctgctcgacgaaccgtttgccggggttgacccgatctcggttatcgacattaaacgcatcattgagcacctgcgcgacagcggcctgggcgtgctgatcactgaccacaacgtgcgtgaaacactggcggtttgtgaacgcgcttatatcgtcagtcaggggcatttgatcgcccacggcacgcctacagaaatcttacaagacgaacacgttaagcgtgtataccttggggaagacttcagactctgatagggtagaagtttgcgacgttttagcaggagagtacgattctgaacatgaagcaaggtttgcaactcaggcttagccaacaactggcgatgacgccacagctccaacaggcaattcgtctgttgcagttgtcgacgctggaacttcagcaggagctacagcaggcgctggagagcaatccgctgcttgagcaaatcgacactcatgaagaaatcgacacccgcgaaacgcaagacagtgaaacactggacaccgccgacgcgctcgaacaaaaagagatgccggaagagctgccgctcgatgccagttgggacaccatttacaccgctggtacaccatccggcaccagcggtgactacattgacgacgagctgccggtctatcagggcgaaacgacacagaccttacaggattacctgatgtggcaggtcgagttgacaccattttccgacactgaccgcgcgattgctacctctatcgtcgatgccgttgatgacaccggttatctgactgtcccgctggaagatattctcgaaagtatgggcgatgaagagattgacatcgacgaagttgaagccgtccttaagcggatccaacggtttgatccggtcggtgtggcggcaaaagatctgcgtgactgcctgctgatccaactctcccaattcgataagaccacgccatggctggaagaggccagactgatcattagcgatcatctcgatctattagccaatcacgacttccgcactttaatgcgcgtcacgcgtctgaaagaagatgtgctgaaagaagccgtcaatctgatccagtcgctcgatccgcgccccgggcagtcgatccagactggcgaacctgagtatgtcattccagatgtgctggtgcgtaagcataacggtcactggacggtagaactcaacagtgacagcattccgcgtttgcaaatcaaccagcactacgcctcgatgtgcaataacgcgcgcaacgatggtgatagccagtttatccgcagcaatctgcaggatgccaaatggttgatcaagagtctggaaagccgtaacgatacgctactgcgcgtaagtcgctgtatcgttgaacagcagcaagccttctttgagcaaggcgaagaatatatgaaaccgatggtactggctgatatcgcccaggccgtcgagatgcatgaatcgacgatatctcgcgtgaccacgcaaaaatacctgcatagtccacgaggcatttttgaactgaagtatttcttttccagtcacgtcaatactgaaggcgggggtgaagcctcttccacagcgattcgcgcactggtgaagaaattaatcgcggcggaaaacccagcgaaaccgttgagcgacagcaagttaacctctttgctgtcggaacaaggtatcatggtggcacgccgcactgttgcgaagtaccgagagtctttatccattccgccgtcaaaccagcgtaaacagctcgtttgacccaaccgataaggaagacactatgcagctcaacattaccggaaataacgtcgagatcaccgaggcactgcgcgaatttgttacagccaaatttgccaaacttgagcaatattttgaccgaatcaaccaggtctatgttgttctgaaagtggagaaggtcacccacacctcagatgcaacactgcatgtaaacggtggtgaaattcatgccagcgcggaaggtcaggacatgtacgctgccattgatggcttaattgataagctggcacgccagttgaccaaacataaagataaactgaaacaacactaattgtccgggcaattagcatgtgcatggcggcctgttgtgcggcacaacgggccatttgtacggttaatgctccgagcctgttccactgtttgagtgggcaggttcttaggtgaaattatgacaaataatgatacaactctacagcttagcagtgttcttaacagggaatgtacgcgaagccgcgtccactgtcagagcaaaaaacgcgccctggaaatcatcagcgagctggcagcgaaacaacttagcctggcgccccaggtggtttttgaagctatcctgacgcgggaaaaaatgggcagtaccggtatcggcaatggtattgccattccgcatggcaaactggaagaagatactctgcgtgccgttggcgttttcgttcagctcgaaacacctatagctttcgatgccatcgacaaccaaccggtggacttactttttgccctgctggtgccggcagaccaaactaaaacgcacctgcatactctgtcgctggtggcgaaacgtctggcggacaaaaccatctgccgccgtttacgcgcagctcagagcgatgaagagctgtatcaaatcattacggataccgaaggtactccggatgaagcgtagttattcggtaatgtctcttttagacgttgtgaggagaaacagtacatggtactgatgatcgtcagcggacgttcaggttcaggtaaatctgtcgccctgcgtgcgctggaagatatgggtttttactgcgtggataaccttcccgtagtgttgttacccgatctggctcgaactctggccgatcgagagatttctgccgccgtcagcattgatgttcgtaatatgccggagtcaccagaaatattcgaacaggcgatgagtaacctgcctgacgctttctcaccgcaactactgttcctggatgccgaccgtaataccttaattcgtcgttacagtgacacgcgccgactgcatccgctttccagcaaaaacctgtcgctggaaagtgctatcgacaaagaaagcgatttgctggagcctctgcgttcgcgagcggatctgattgtcgatacctcagaaatgtccgttcacgagctggcagaaatgctgcgtacccgtctgctgggtaaacgtgaacgtgaactgaccatggtctttgagtctttcggcttcaaacacggtatccctatcgatgcagattacgtctttgacgtgcgcttcttgccgaacccgcactgggatccgaaactgcgcccaatgacaggtcttgataaacctgtcgccgcgttcctcgaccgccacacagaagtacacaattttatctaccagacgcgaagctatcttgagctatggttacctatgctggaaaccaacaaccgtagctacctgacggtcgccattggttgtaccggcgggaagcaccgttcggtgtatattgcagagcaactggcagactacttccgctcgcgcggtaaaaacgtccagtcacgccatcggacgctggaaaaacgtaaaccatgaccgtcaagcaaactgttgaaatcacaaacaagctgggcatgcatgcccggcctgcaatgaagctgtttgaattaatgcagggttttgacgctgaagtgctgttacgtaatgacgaaggcaccgaggctgaagccaacagcgttattgcgctgctgatgttggattctgccaaaggacggcagattgaagttgaatcgaccggtccacaggaagaggaagcactggccgccgttatcgccctctttaactctggttttgatgaaaattaatcttcatcactttgacattcaaatcccttcaagctcccccggcaataagaaaagcgcgtactgaaatcgttatcaatcaacgtcgattgtacatttcgtgcgcttttttactttcagaagaaccttaagaaaaccttaagaagcattgtttagatttcgtttaagttaatcgaccatactggagatcgtcagaaaatatttccaggagatggcatgattcgcttatctgaacaaagtcccctgggcaccggaagacatcggaaatgttatgcgcatccggaagatgcccaacgctgtatcaagattgtctaccatcgtggcgatggtggcgataaagagatccgccgtgagttaaagtactacgcgcatcttggtcgccggttaaaagactggagtggaataccgcgctatcacggtaccgttgagacggattgcggaaccggttatgtctacgatgtgattgccgatttcgacggcaagccttccattacgctgaccgaatttgcagaacaatgccgttacgaagaagacattgcacaactgcgccagttactgaaacagctgaagcgttatttgcaggataaccgtatcgtgacgatgtcgctgaagccgcagaatatcctctgtcaccgcatcagtgagtcagaggttacccccgtcgtctgcgacaacattggtgaaagcacattgattccactggcgacctggtcgaagtggtgttgtctgcgtaagcaagagcggttatggaaacgatttatcgcccaaccggcgctggctattgccctgcagaaagatctgcaacctcgtgagagcaaaacgctggccctcacttcgcgcgaagcttaatcaagctggtgttgttgcataaacggctcaccgcctaactgatacatctgccgtaaaatccacgcctgacggctacgcacgtagcccgatggcgcggagactttgaaacgaagtggattaggtaatacagctgccagcaatgcagcttccgaccgggtaagtttgctcgcgggtttgtggaaataacgttgtgccgcagcttcgacgccaaacacaccgtcgccaaattcggcgatattcaggtaaaccgccaggatacgctttttgctccagactgtttctatccccagcgttaatccggcttccagcccttttcgaacccagctacgcccatcccataaaaagagatttttggctgtctgctgagaaatcgttgaagcaccgcgaatacggttttcattgcgctcgttgtgcgccagggcttgctcaatggaagcgacatcaaagccccagtgctcaggaaatttctgatcttctgcggcaatcaccgccagtcccatccacggcgagatttgatccatactgacccagtcagaatgtgccacgtaacgaaaattgccatgcagccaggcgctgacttgccgctcgaccattaccgctgagaaaggaacaggcgcaacgctaaacaacgcgatgcccccgccccagaaaatggcgaggacaaccattaaccgcagaagaaaacggcgaacgaaactaaacaccgttaagcggcttttactcattcagccagaaccagcacgcgggaaaccagcttatcaatgccgttcgccgcttctgcaatgttctgcgccagcatatatgccggggtggtgacaatcttattgtcttcatcaaccacgatatcatcgacaggacacggcacatgctccgcgcccatctcttccagcacttctgcggtatcgatatcagtaccgatggtcaaacgtagcgggaaatcgaaaattttcggcagtatcgccggtgcaatacacataaaaccaagcggttttccggcctgatgcatcgcttgtgccagcgcctttaattcacggtcaacggtgcattcgctaccaagactggcaaaattgcttaaattcttcgccgcgccaaaaccccccggcacaatcaacgcatccagttcagcggcatcggcctgggccagaggacgaatttcaccgcgcgttattcgtgccgcttcaatcagcacattgcgcgtttccgtcatcgcttcaccagttaaatggttgataacatcaacctgctgcttatccggtgcaaagcagaccgcctgcgcaccgctgcgtgaaatagctaacaacgtcaacaccgcttcatgaatttcagaaccgtcatagacgccgcatccgctcagaattacgccaattttcttcattgtgatcttcctttcgcaattgactgaaacacattaatttttttaataaaaatgctacgcatcacacatttaactgattcatgtaacaaatcatttaagttttgctatcttaactgcgtgcggcctgaaaaacagtgctgtgcccttgtaactcatcataataatttacggcgcagccaagatttccctggtgttggcgcagtattcgcgcaccccggtctagccggggtcattttttagtggcttttgccacccacgctttcagtacttctacgtcgtgacgccactcttctttcatctcttcaatccattcaccgacgttatcttcccaggcgggaaggtcaggagactgaatttgctgacccagctgttgcagatggcgtaaccccactgaccccgctgcacctttaattttatgcccttcctcaacaatgccttttttatcctgcgccgtcagattcgactccagcacgctgacatagcccggcatcattctctcaaacaccgctaacccgtcggtgatcagcttcggtcctacaagttcgagatactgttccagcatgggaatatcgagcaatgcttctgatttactgttctcttctgtcgtcaccgtactctcctcatcatcctgggtatcccagaatttcttgatcatcgcggttagcgccggaacagaaagcggcttactcagcacatcatccattccagcattgaggtactcttgtttgtctttcagcacgttagcggttaaggccaccagcggcggtaaatcctcgcgcggataacgcttcgtcagttcacgagagatatccagcccggtcatatctggcaactgaatatccagcaacaccaggtcgtattcgcccggtttaaacatctccagcgccgccttgccggtcatggcgacatcaacgctgttacctaacttttccagcacagagcgcgcgacaatcacgttcagttcaatgtcttccaccagcagcacattcagcgccggtaaaggcatatcgtcttcatcaaacgcatcatcaacctcttctgctaccgacggtgcgtggatcgtcaacgtaaaggttgaacctttgccctgttcgctggtaaccataatatcgccgcccatatttttcgccagacgacgagaaacggccagaccaataccggtgccggtggcaggtttaccgccatgactgtctttcacctggtaatacatggcgaagattttatccagctcatcctgcggaatgccgataccagagtcttccacttcaaaatgcagcatatcgccttcatcgtagcgcacgcgcacggtaacctggccttgctgagtgaatttgacggcgttactgatgaggttccacaagatctgccgtaaacgcgtcccgtcggtaatgacctgatgcggtaatggcagcgtcggctccagattaaagcgcaatcctttttgttgcgcctgcaatgcggagagattttccagatcggcaaggaagctggtgaaatcaaccggttgattatcaagctggaccttgcgccgttccatcttatccatgtcgataatatcgttgaagatattccccagcgtgacagccgaaacatggatggttttgagatatttttcctgctcggcggtgagttcagtatccagcagaatgcggctcaggccgacgataccgttcagcggtgtacgcaattcgtgactgatggtggagataaacgtcgttttgtcgcggctggcgcgctcaagcgcatcctgataccgcttacgctcggtaatgtcgcgaccaaagcccatcaaaccgtgacgtttacccacgcggtcgtagtacggtactttacggatttcaaagcaggctttgcgtccgtcgggataatccagccactgctcataggtcagtgacacattatgacggaacactttttcatcggtttcaatgactttcgcagcggcttccggtgagtaaacatcagcaggtttcaggtgaaccagttgtttttcgctttttccggtcagcagctccatcgcgcggttacagccggaaaactctttatcttcgttacgataaaaaaccaggtcgggtgaagcgtcaaggaaggaacgtaagaatgaggattgctgctcgagctgaatttgtgtctcttcgcgctctttgatttcaattttcagttggccgaaggtttcctgcagttctgcttccgctttttcacgaacggcgatttcctgatttagctgggcaatattatcttttaactgaacgttgaggctcaaatcgcgctcacgcatctcctccagtttttgcaccagtcgtgacagacgttgtcgtgactcctccagttgctcgacgaccaccgatagaaagtagaccgcccacggcgtaatcagcaaaccaaagaagatagaacgaataacatcaatgctttcgacctggccatgcagcaccatggttaccgccatttgtaccacaatggcaagaacgacgagggccagcgccagcaacattgagaagcgcaccagacctaacttcatcatcaggtcaacataatactgcgccagcagacgaatttgcttcattagggaattccttcacgacaacctgccccaataatacccaattctgacagttacgttataaattgtgtgagaaatgcggaattcccctcaatggcctacgccgttggaggtagccacggacgtcccagcgccgatccctgtacgccatgttcattcagataacgatccagcccgaccattcccgtccatcgattttcgcaccacagcggagcaagcagcgtcgggcgacgggcgctggcggaaatgcgatggtagatcacttccggtggcgtatggcgaatcatttctccggcagtgagcgtgtaatcctccagttcaattccgttcaaacgccccgcttcccaggctttcgccataatgctgcctttcactatatgcagcggatgcagctttatgccgtccacgccggtttcaaccactcgctccagcgtttgcaaacattcagcctgcccttcgccaggcaggccaacaattaagtgagaacacaccttcagcccgcgctcacacgccagctgcgtcgtgcgctgatagcaggcaaaatcatgaccgcgattgatgcgatgcagtgttttgtcgtgggcggtttgtagccccagctccagccacacttcgtagccctggtccttatattcgcaaagcaaatccagaaccgcatccggcacgcagtccgggcgggtaccaacacacaaaccgacaatattggcctggctcaccgcctgctgatacatcgaacgcagcacctgaacttccgcaaaggtgctggtatacgcctgaaagtaggccagatagcgtttagcgcggttaactaaattcgcctggtgcgccagttgctcggcaatagaacgatgctgctgcgcttcatcggcaaacgaggcaacattacagaatgtgcagccgccacgcccgatggtaccgtcacggttagggcagctaaaaccgccgtgcagcgtcagcttatgcaccttttgcccataacgacgggtgagatcaccaccaaacatattgactaatttctgtaactgcataatctgatagaccgcgccttgaaaagaggccaaagcctgccatttttagcccaattcggcgatgacctggatcaatcgtcccggcctgcttttatcaactgcataatcaatcaaaattaccgaaatttcatgcacaatcacataaatcacttttgcttatcttgtgtcagatttttttatctccttatggattttaggcaaaaacagtagcatgaaacgttattaccaattaaggcagtataaaatgctggctctctcgtcaattcaaggcaggataagggttaacacgcctttatgacagtcaggaattggctgtttctctaacgacgccccttttagccttaaatagaaaatccaatttaatttcagataattaataaagaattttgcgctaaagcacatttctgtaccaataagcttgccatttgacctgtatcagctttcccgataagttggaaatccgctggaagctttctggatgagcagcctgctcatcatatttatgcagtaattgagatcccctcttcaccgtattaaccgatgcgaaaaggacaacaagggggcgaatgcgaggcgcgcgtatgacacgcaaaccccgtcgccacgctcttactgtgcccgtgcgcagcggttcggaagtggggttcccgcagagcctgggggaggttcacgatatgttgtacgataaatcccttgagagggataactgtggtttcggcctgatcgcccacatagaaggcgaacctagccacaaggtagtgcgtactgcaatacacgcactggcccgcatgcagcaccgtggcgcgattctcgccgatggtaaaaccggtgacggttgcggcttgctgttacaaaaaccggatcgtttttttcgcatcgttgcgcaggagcgcggctggcgtttagcaaaaaactacgccgtcgggatgctcttcctgaataaagatcctgaactcgccgctgccgcacgccgcatcgttgaagaagagctgcaacgcgaaacgttgtcgattgtgggctggcgtgatgtccccactaacgaaggcgtgctgggtgaaatcgccctctcctctctgccacgcattgagcaaatttttgtgaacgccccggcaggctggcgtccgcgcgatatggagcgccgtctgtttatcgcccgccgccgcattgaaaagcgtctcgaagccgacaaagacttctacgtctgtagcctgtcgaatctggtcaatatttataaaggtctgtgtatgccggcggatctgccgcgcttctacctggacctcgctgacctacgtctggaatcggccatctgcctgtttcaccagcgcttttccactaacaccgtaccgcgctggccgctggcgcagccgttccgctacctcgcgcataacggtgaaatcaacaccatcactggtaaccgccaatgggcgcgtgcgcgtacctataaattccagacgccgctgatccctgacctgcacgacgccgcgccgttcgtcaacgaaaccggctctgactccagttccatggataacatgctggaactgctgctggcaggcgggatggatatcatccgcgccatgcgtctgttagtaccacccgcctggcagaacaacccggatatggacccggaactgcgtgccttctttgactttaactccatgcatatggagccgtgggatggcccggcaggcatcgtgatgtctgacggtcgttttgccgcctgtaacctcgaccgtaacggtctgcgtccggcgcgctacgtcatcaccaaagataagctcatcacctgcgcctctgaagtcggtatctgggattatcagcctgacgaagtggtcgaaaaaggccgcgtggggccaggcgaactgatggttatcgacacccgcagtgggcgtattctgcactcggcagaaaccgatgacgatctgaaaagccgccatccatataaagagtggatggagaaaaacgtccgccgactggtaccgtttgaagatctgcccgatgaagaagtgggtagccgcgaactggacgacgacacgcttgccagctaccagaaacagtttaactacagcgcggaagagctggattcggtgatccgcgtactgggtgaaaacggtcaggaagcggtcggttcgatgggcgacgacaccccgttcgccgtgctctccagccagccgcgcattatttacgactacttccgccagcagtttgctcaggtaaccaacccgccaatcgacccgctgcgtgaagcgcatgttatgtcgctcgccaccagcattggccgcgaaatgaacgtcttctgcgaagctgaaggccaggcgcaccgtttaagctttaaatcgccgattctgctctattccgatttcaaacagctcacgacgatgaaagaggatcactaccgcgcagatacgctggatatcacctttgacgtcactaaaaccacgctcgaagcgacggtcaaagagctgtgcgacaaagccgaaaaaatggtacgtagcggcaccgtgctgctggtgctctccgaccggaatatcgcgaaagatcgcctgccggttccggctccgatggcggttggcgcgatccagacccgtctggtcgatcaaagcctgcgttgcgatgccaacatcatcgtcgaaaccgccagcgcccgtgatccgcaccacttcgccgtgttgctgggtttcggcgcgacggctatttatccgtaccttgcctatgaaacgctgggccgtctggtagacacccacgcgattgccaaagattatcgtaccgtgatgctcaactatcgtaacggcatcaacaaaggcttgtacaaaatcatgtccaaaatgggcatctccaccatcgcctcttaccgctgctcgaaactgtttgaagcggtcggtctgcacgatgatgtcgtgggcctgtgcttccagggggcggttagccgcattgggggggctagctttgaagacttccagcaggatctgctgaatctgtcgaaacgtgcctggctggcgcgtaagcccatcagccagggcggcctgctgaaatacgtgcacggcggcgaataccacgcctacaacccggacgtggtgcgcacgctgcaacaggcggtacagagcggcgagtatagcgactatcaggaatacgcgaagctggttaatgagcgtccggcaaccacgctgcgcgatctgctggcaattacgccgggtgaaaacgcggtcaacattgctgatgttgaaccggcaagcgaactgtttaaacgcttcgataccgccgcgatgtctatcggcgcgttaagcccggaagcccacgaggcgctggcggaagcgatgaacagcatcggcggtaactcaaactccggcgaaggcggtgaagacccggcgcgctatggcactaacaaagtgtcgcgcatcaagcaggtggcgtccggtcgcttcggcgttactccggcgtatctggtcaatgccgacgtcattcagattaaagtcgcccagggcgcgaagccgggagaaggcggtcagttgccgggtgataaagtcactccttacattgccaaactgcgctattcggtgccgggcgtgacgctgatctccccgccgccgcaccatgatatctactctatcgaggacttagcgcagctcattttcgacctcaagcaggttaacccgaaagcgatgatctccgtgaagctggtgtccgaaccgggcgtcggcaccatcgcgaccggcgtggcgaaagcttatgcggacttgatcaccatcgcaggctatgacggcggcaccggcgcaagtccgctttcatcggtgaaatacgcaggctgtccgtgggagctggggcttgttgaaacccaacaggcgctggttgccaacggcttgcgtcacaagatccgtttgcaggtcgatggcggcctgaaaacgggtgccgatatcatcaaagcagcgattcttggcgcggaaagttttggcttcggcactggcccgatggtagcgcttggctgtaaatatctgcgaatttgccacctgaacaactgcgccacgggtgtagcaactcaggatgacaaactgcgtaagaatcactatcacggcctgccgttcaaagtgacgaattactttgagtttatcgcccgtgaaacccgcgagctgatggcacagctgggcgtaacacgtctggtggatctgattggtcgcaccgacctgctgaaagagctggacggtttcaccgccaaacagcagaaactggcgctgtcgaagctgctggagactgccgagccgcatccaggtaaggcgctctactgcaccgaaaacaacccgccgtttgataacggcctgctgaacgcgcagttgctgcaacaggcgaaaccgtttgttgatgaacgccagagcaaaaccttctggttcgatatccgcaacaccgaccgttctgtcggcgcatcgctttcaggctatatcgcccagacgcacggcgatcaggggctggcagccgatccgatcaaggcgtacttcaacggcaccgcaggccagagcttcggtgtgtggaacgcgggcggcgtggaactgtatctgaccggcgatgctaacgactatgtcggtaaaggcatggcgggcggcttaattgccattcgtcctccggttggctcagccttccgcagccatgaagcaagcattatcggcaacacctgcctgtatggcgcgaccggaggtcgtctgtatgccgcaggccgcgcgggtgaacgtttcggcgtgcgtaactccggtgctatcaccgtggtagaaggcattggcgacaacggctgtgaatatatgacgggcggtatcgtctgtattctgggtaaaaccggcgttaacttcggcgcgggcatgaccggtggcttcgcttacgttctcgatgaaagcggcgatttccgcaaacgcgttaacccggaactggtcgaggtcttaagcgttgacgatttggcgatccatgaagagcatctgcgtggtcttatcaccgagcatgttcagcataccggttcccagcgtggtgaagagattctggcgaactggtcaaccttcgccactaaattcgcgctggttaaaccgaagtccagtgatgtaaaagcactgctgggtcaccgtagtcgtagcgcagcagagttgcgcgtgcaggcgcagtaaggggtagcaacaatgagtcagaatgtttatcaatttatcgacctgcagcgcgttgatccgccaaagaaaccgctgaagatccgcaaaattgagtttgttgaaatttacgagccgttttccgaaggccaggccaaagcgcaggctgaccgctgcctgtcgtgcggcaacccatactgcgagtggaaatgcccggtacacaactacatcccaaactggctgaagctcgccaatgaggggcgtatttttgaagcggcggaactgtcgcaccagacaaacaccctgccggaagtttgcggacgtgtctgcccgcaagaccgtctgtgcgaaggttcctgcaccctgaacgatgagttcggtgcggtgaccatcggcaacattgagcgttatatcaatgataaagcgttcgagatgggctggcgtccggatatgtccggcgtgaaacagaccggtaaaaaagtggcgattatcggcgcaggtccggcgggtctggcgtgcgcggatgtcctgacgcgcaacggcgtaaaagcgatcgtcttcgaccgtcacccggaaattggcggcttgctgaccttcggtattccggctttcaagctggaaaaagaggtaatgacgcgccgccgtgaaatcttcaccggcatgggtattgaattcaaactcaataccgaagtgggccgcgacgtgcagctggacgatctgctgagtgattacgatgccgtgttccttggcgtcgggacttatcagtcaatgcgcggcgggctggaaaatgaagacgccgatggtgtgtacgcggcgctaccgttcctcatcgccaacaccaaacagttaatgggctttggcgaaacccgcgacgaaccgttcgtcagcatggaaggtaaacgcgtggtggtccttggcggtggcgacactgcgatggactgcgtgcgcacgtctgtacgccagggggcgaagcacgttacctgtgcctatcgtcgtgatgaagagaacatgccgggttcccgccgcgaagtgaaaaacgcgcgggaagaaggcgtagagttcaaattcaacgtccagccgctgggtatagaagtgaatggcaacggcaaagtcagcggcgtaaaaatggtgcgcacagaaatgggcgaaccggatgccaaaggccgtcgccgcgcggagattgtggcaggttccgaacatatcgttccggcagatgcggtgatcatggcgtttggtttccgtccacacaacatggaatggctggcaaaacacagcgtcgagctggattcgcaggggcgcattatcgccccggaagacaacgacaacgctttccagaccagcaaccccaaaatctttgctggcggcgatattgtccgtggttccgatctggtcgttaccgccattgccgaaggtcgcaaagcggcagacggcattatgaactggctggaagtttaagcgaggtaacaataaattcgccagacagtgtctggcgaatttataaaacgagctatccaactaaattttaagccattaaatcaaccttaatcttcactaccacctttttaatctcaccaggttcgccaacaacgcatcccggtttatgcggttctcctggcataaacacggcgaacattcccggtttcaggatgatggcttgctcgttttcaatggcgctgcaaagctgataatcatcttcatggtggaactcttcacactgacgcgcagtgcctgccatgccaaacagaatccgttcctcaccgtttaataacagctggatatcaatgtattgttcgtgcaattcggcttttttctcaacgggcgattgagtattaaatgtcatgacattcataaagatattgtcgccctgtaattcgtaacggccaggcgctttttcttgcggtctggcagctaatgccaacgttaacgcgtcctgtaacgcaggatgtaatccggcagacggtaatgactgtacttcacccatcatcataatatttctccctgggccaacagcgcagccccaagtaaacctgcatcgtggcggtagtgcgccgccagtaaatcaacatgaaatgccgctggctcctgcgccagatacgtttccaccagcgccagatacccttctgccagaccaacgctgccaccgaccaccacgcactggcaatcagttgtggctttaatatcagcgatcagccttgcaagcgtacgtgcggagcggtgaatcagttgctgcgcctgctcatcaccctgcccggcgcgcgtgaaaatagttttcgcattcgcaccagccaactccccctgcgctgccgctgcaatgccgcgaccagaagcaatcgcttccacgcaacctgtgcgtccacagccgcagactggaccatgcggatcggcaagcgtatgcccgatatgccccgccagaccgccagggccggtacgcagtttaccgccgctcactacaccgccgccaacgccggtggaaacagtgataaacaccatatcggttatatcgccatccagcgcctgatactccgcccatgctgcggcctgcgcatcattaatggcaatggtcggcaaattggtaagttgctccagcgttttgactaacggaaagtgtaacaatccaccgagattatgcggattcagcgccagcaagctgccgtcgcgaataattccggttgaagcgatggcaacccgctgcgcatgtgcttgcaacggagagactaatgcggataaggcatcacgcagcgcctgcggagtctggctggcaggcgtaggaagttctcggcgatcgcggatctgcccgtcagcgccaatcagcgcggcggcaagtttagtaccgccgatatcaatcgccagtgtggtcatagcaccgcctttttcatcgctgtgttgtaccactgacaaatgtgttcaagacgcgtaatggcagaaccgaccgtcaccgcccacgcgccgtggcgcatcgcatccgccgcctgagcaggcgtgttgtaacgcccttcggcaatcacccggcatccagcgtcactcaacgttttcaccagcgccagatccggctcttctggcgtttcaggcgtagtatagccagaaagcgtagtgccaataatttcggctcccagcttttggcatgccaggccgtcttccggcgttgagcagtcggtcatcgccagtaaaccgtgatggtgaatacgtgccagcagcgtttcaactggcaccggacgcggtcggtcggtgccgtcaatcgcgataatgtccgcgcccgcctgcgccagcgcatcaacatcttcaatataggccgtgatgcgtaccggagaatcctccagatcgcgcttcacaatcccaataatcggcacgctcaccaccgcacgcgtggcttgcagatttgccacaccttcaatacgaatggcgaccgcgcccgcctgctctgccgctaatgccatggcagcgacgatttcgggtttatcgagcgggctgtccggaaccggctggcaggagacaatcaggccaccgttagcagcgattttttgatccagttgtgcaagtaacgacatacatcttcccttagcgaaaggcccggtacagagaccgggcaacaggattaacttttggttttgactaaattgtttttggcgctgccaaatggcacggcaccgctaaatggtttgccgtcgatagcgtcatgagtacgcaatgcttccgggcgcagccaacgctgaacacgagaaggcatatccagaccaatcagcaggatcaccacaaatgtcagactgaacgagagcgatgccagcgcagtacccagatccagacgttgagcgatcaacgcgccgatgattggggccagtgcaccgcccaatgcgccaacgttgtaggtaaagcccaggcccgctgcacgctggtcggtatcgaaataaccgccaatcagtttcggtaagatcccggcgatcccttgtccaagcatttgctggaagaacagtaacagaccgagcacccagacgtttgcgccgccaatcgcaaataccggaataatcagcagctgcgaggccagcagactacaaacgtacgctttgcgggttcccagccagtcaccgaggaagcccccgacgcagcaccccaccgccgcgccaaagccactaaagaacagcacattggcgacagtatgcgggtcataagccagatcggttttcagatacgttggcagcagcgcctgaatcggccatgagtagaggaaagcgaacaacacgaccaccatcagcattacgcccgttggccagcgtttgcccgtactctgcaccataaagctgataaaaattgcggcgcataacagcccaagaacagcgacgatcgcggcattttgcaggttaccggcgaagcagaaccacagcgcagtagccgccgccagtgtcattacgatattggcaatgcgatgttcaccacggtagagaatatccaccattgtgcgtaccggtgctttacccccgtgtttctctttccagtcttccgcttccgggatgtttttacgcagccagagagcaaagatgattggcaaaatgccgataaagaacagcgcacgccagccccagaccggaaccaccagactatagacctgagcggcaacgacggcccccactgagaagcctgaaatcagaaaaccactggctttgttacgcagatgctttggccagctttcaatgacataggtggcgctggaaccgtattcacccgccatccccatgccaatgaccagacgagcgataaacatggtgatgtagcctggcgcaaagccgcaggccagcgtcccggccgagaagagaacgatgctggtgaccattgccagacgacgcccgtagcggtcacccatagcgccgagcatcaggccgccgaaccagcgagagataaaggctgcggagatcagacttgccgcctgcaccgtcgtcagcccgaattcaccctgtacttcggtgagtaccagggcgattaaaacgaaatcaaaaccgtcaagcagatatcccaaccaggctgcggaaaatgcccgccattgtgcgcggttaagatggcgataccacgggatattctgggttgtagtactcattgtgagtctcccgcggtgggcgatgcccacacgctttggtatgaaaattgtagggtacagatgcgtttatttcccctcacccggtaggggcgagcgaggggaaacaactcacccgcgctcttgcatcaactgctgggccagcgccttcagttctggcagatatttttcatctaccggaccaaacggtttgcggcacagcggcacagaaacgacatccatataatgcaggacagttttcaggccgcggaatacgcccgttttgatcagtaaatcaatgactttgttgcactcagtttgcagtttctgcgcggtctggatatcgccttctttcagcgccttcacgatcccctgataacgccagcccatgatgttgtaagtgctgccgataccgccgtctgcgcccgccagaagaccagaggcgaagatttcgtcgtaaccgttatagagcaccagatcaggatgttcacgacggatctgctccatctgatagagatcgccagaggtctgtttcagcgcacctacaccaggcagcgtaaccagggtcttgatctgatccagggtcagttttaccccgctcagggctggaatgttgtacaccaccatcggcaacccatccgccgaatcaataattgcccgatagtgatcgcagtgttcttcaaagctgaaaggatagtagaacggcgtgacggcggagacggcatcgaagccataacgtttagccgatgccgcaagttgttggctttcggcggtgctgacgcaaccgacgtgggcgatgagtttaatcttacctttcgcctcttcggcgacgatttccagtacctgttcgcgctcggaaaggctttgtacaaaggcttcgcctgtcgaaccacccacgtacaaaccgtcgatgccctgctgaatattgaactgaaccaggcggcgcagactcgctttatccagtgcttgttgttggtcaaaaggagtcaggagtgcagccattacgccacgtaaattcgttgccataaatacctctgaagtgatgcttgtctgataaacgatatacctttatacctgttataccagatcaattaagcaacaccccatacagaaagcttataatgcgatctgcttcactaaagtggcattatttctttttgttggtggtctgaccgaaggcgtgccaggtagcagagacgctgttgagatgcgattgcaacgcgcgatcggcttcgtcaggatcatgacggcggatcgcgtcaacgatcgcaatatgctgttgatagctaacgttgttatgctcatgcagagcctgatcggccacggttggacgtgcggcgattagccagtcgagcagggcaacgtggatcgccatgaagattgggttaccagggatctccgccagaacgcggtggaaatcaacgtctgagcgaatgaatgccgcgttgttatccagcgactgactgttgatttccagtgcttttgccagcaaatcgatttgctcatcggtggcgtgttcagccgcatagcgcaccaggctggattcaaagaacagacgtaattgttcgaaatgggcaatcccaccaggatgagaaaggaaatctttcgccatgccggaaagctcgccgatgatggtgtccgcagaaggacgtgagacgcgggcacgttcgccgttgtttatttgcaccagacctttgcgttttaacgctgccagcgcttcgcgcaccgaaggacgcccgacgttaaagaacgccatcagttcgcgttcagacggtaattgttcaccttcaccaaattcacgacggcggatcatctgttccagctcttcttccaccatttcggagagttttttacgcgccagcgggcggctgcgcaagttgcgcccgatagtggtagtagaatcttcagcttgcggatcaaatgcgttcataggactcattcaggaaaatgcgttagcggataataacgacgctatcgtagcacagtatcaaagtcaggcgaaaagatgacagatagcaaaacaggccacatgggcctgttttcattttacttcacaacgcgtaatgccggtcgaccaccgcgtggtggctgcggaggttcatcgtcaggatgagtttcatcatcgtgatctggcttgtcgccatcgataaccgacataacggtttcgttgtctgccgatgcctcttcatcattcatgatgctggcatcttcatcgtaggcagcttcaggctcaaacatcgtgcctgcgccattttcacgggcgtagatagctagcacagcagccagcggcacagaaacctgacgcggaatgccaccaaagcgcgcgttaaagcgcacctcatcattcgccagttccagattgccgacagcacgcggcgcaatgttgagtacgatttgcccgtcacgcgcatattccataggaacctgcacgccagggagcgtcacatccaccaccaggtgcggcgtgagctggttatccagcaaccactcatagaatgcacgcagcagatagggacgacgtggtgttagctgtgacaaatccatacagattaactccggcccagacgcatttcacgttctgcttcagttaaagaagcaaggaaagagtcacgctcaaatacgcgggtcatatagcctttcagctctttcgcacccgggccgctgaactcgatgcccagttgcggcagacgccacagcagaggagcaaggtagcaatcgaccaggctgaactcatcgctcaggaagtacggcttctgaccgaagaccggcgcaatcgccagcagttcttcgcgcagttgcttacgtgcggcatcggcttcagaagctgaaccgttgatgatggtgttcatcagcgtgtaccagtctttttcgatgcgatgcatgtacagacggctttcaccgcgagctaccgggtaaacaggcatcagtggcggatgcgggaaacgctcatccagatattccataatgatgcgagattcccacagggtcagctcacgatccaccagggtcggaacgctctgattcgggttgaggtcaatcagatcctgaggcggattgtccttttccacgtgttcgatctcgaaacttacacctttctcagccagcacaatgcggacctgatggctatagatgtcagtaggaccggaaaacagcgtcattaccgaacgtttgttggcagcgacagccatgaaaacctccaggtatagtcagaatttttactgctaccagccaccaggtggccagtcagaagttgtgttacccagtaaggaacgactctctttgtttgaaaatcaaacaaaaaatgagcaatacccgacatttgggcagaaaattggatgatagtttaccagattttgcgacctttgtggtgagtcgatgccggaaatggggaaaaagagatgcgctttagtctgaaatagttgacttagtcccttattggcgatgtggtttttgttttacctgtctgtcaggtggcagcaaaaagcaactttccattttttacgctgatgcagattttagccataaaaaaacccgccgaagcgggttttttcgcaaattgttttctgccggagcagaagccaattaacgtttggagaactgcggacgacgacgtgctttacgcagaccgactttcttacgttcaacctgacgagcgtcacgagtaacgaagccagctttacgcagttcagaacgcagggactcgtcgtattccatcagagcgcgggtgataccgtgacggatcgcaccagcctgaccagagataccaccacctttaacggtgatgtacaggtccagtttctcaaccatgtcgaccagttccagcggctgacgaactaccatgcgagcagtttcacgaccgaagtactgttccagagaacgttggttgattacgattttaccgttgcccggtttgatgaaaacgcgagctgcggaacttttgcggcgaccagtgccgtagtattgattttcagccattgcctataatcccgattagatgtcaagaacttgcggttgctgtgccgcgtggttgtgctcgttacccgcgtaaactttcagtttacggaacatagcacgacccagcgggccttttggcaacatgcctttaaccgcgatttcaatcacacgctcaggacggcgagcaatcatctcttcaaaggtcgcttgtttgataccaccgatgtggccggtgtggtgatagtacactttgtcagtacgcttgttgccggttacagcaactttgtcagcgttcagaacgatgatgtaatcaccggtatctacgtgcggagtgtattccgctttgtgcttaccgcgcaggcgacgagccagttcagtagccagacggcccagagttttaccggtcgcgtcaacaacataccagtcgcgttttacggtttctggtttagctgtaaaagttttcattaaaagcttacccaataaatagttacacgttggtgaacacccaaacgtcttcaattgttgaggttcacacgacaaagtccggcaaacctaccccttcgaatagcctatgccagcacacaaaaagtttcgggaaaaaaaactttcttgtaacgtggggtcgcaggattatagagaagtcggggtcaaagatcgacccctttttgtgatttgtggcaggttttaccccgccaaatgctcgcgcttcaaatactcttcgctttgcatctcttgcagacgtgacaggcaacgctggaactcaaacttcagccgctcaccctgataaatttcatacagcggcacttctgcactcaccactaatttgacatggcgctcgtaaaactcatccaccagcgcaataaagcgtcgcgcttcgctctccatcaaccgcgtcataactggtacatcaaacaacatgaccgtgtaaaagaggcgtgagagcgcaatatagtcatgctgactgcgggcgtcgacgcacagcgtagtaaaagaaaccgccagcgtctggttctcgacgcccattgtcgccaatggccgatggttgatttctaacgtcggtgaattttctcgtttcgcccccgccagcgccaaccatagtttatccatttgcgcccgggtttcatcgttgaggggcgaaagccacagatgcgcctgagtgagtgtacgcagtcgataatcaacaccagcgtccacgttcattacatcacaatgccgtttaatagcatcgattgcaggcaaaaaacgcgcacgttgcaggccatttcgataaagttcgtccggcggaatatttgacgtcgctaccagcgttattccgcgagcgaacagggctttcatcaggccgccaagtagcatggcgtcggtaatatcagaaacaaaaaattcgtcaaaacagagcacgtcagtttctgctttaaagcgatcggcaataatttccagcggatcggtctgcccctgcaaagcagttagctcttcatgtacccgcagcataaaacgatgaaagtgcaggcgctgtttccgctctcccggcagactttgatagaaaaggtccatcagccaggttttcccgcgtcctacaccgccccacatatataagccacgcactggcatatgctttgtgtcttcgcgtttaccccacagcttaccgacccgcgccattagcccactcgtcctgggggctagtggcgtgctattgatgagttcctgataaataatttccaggcggctgacggcctctttttgaacgtcgtcgggttgatggctgccttcattgagcgccttcaggtattgcgatgttggggtaacgctttgcatgatcttattgttattccttgaataatcggtgcgccgttgttcacggttgacgaaaaaaaggccgttctacactacgcgatatgcagtcgggattccacttctgtggaattaacggttatagtggcataatcagccgcaggcatggagcctgaagccaacaccctacggaaacaaaagacaacgggagatgttcatgacctgggaatatgcgctaattgggttagtcgtcggcatcattattggtgctgtggccatgcgttttggtaatcgtaaactacgccagcaacaggcgttgcagtacgaactggaaaagaataaagctgaactggacgagtatcgcgaagagctggttagtcactttgcccgcagcgcggaattactggataccatggcgcacgactatcgccagctgtatcagcacatggcgaaaagctccagtagcctgctgccggaactgtctgcggaagcaaacccgttccgtaatcgtctggcagagtctgaagccagcaacgatcaggcaccggtgcagatgcctcgcgactattctgaaggcgcatccggcctgctgcgtactggcgcgaagcgcgactaatttatttttcgggcgcagccattgcgccctcctcttctctccctccccgactatcatttaatctggtgtctcattgttagccgtctgaaaattcaataacatcaaactgttttgaatctcttttcttatcattcaggtacgagagcaggaataatgaaaaaacaaacccagctgttgagtgcattagcgttaagtgtcgggttaactctctcggcgtcatttcaggccgtcgcgtcgattccaggccaggttgccgatcaggcccccctccccagtctggctccaatgctggaaaaagtgcttccggcagtggtgagcgtacgggtggaaggaacggccagtcagggacagaaaatcccggaagaattcaaaaagttttttggtgatgatttaccggatcaacctgcacaacccttcgaaggtttaggctccggtgtcatcatcaacgccaataaaggctatgtgctgaccaacaaccatgtgattaatcaggcacagaaaatcagtattcagctcaatgatgggcgcgagtttgatgcaaaactaattggtagcgatgaccagagcgatatcgccctgttgcaaattcaaaacccgagcaaattaacgcaaatcgctattgccgactccgataaattgcgcgtcggtgattttgccgtggcggtcggtaacccatttggccttgggcaaaccgccacctctggcattatatccgcattaggccgcagcgggttgaatcttgaaggtctggaaaactttatccagacagatgcttccattaaccgcggtaactccggcggtgcactgttaaaccttaacggtgagttaattggcatcaacactgcaatccttgcgcctggcggcggtagcgtcgggattggatttgccattcccagtaatatggcgcgaacactggcgcagcagcttatcgactttggagaaatcaaacgcggcctgttaggcatcaaaggcaccgagatgagtgccgatatcgccaaggccttcaaccttgacgtgcagcgtggcgcgtttgtcagcgaagtgttgccaggttctggctcggcgaaagcgggcgtcaaagcgggcgatattattaccagcctcaacggcaaaccgctgaatagctttgctgagttgcgctctcgtatcgcgaccaccgagccgggcacgaaagtgaagcttggcctgctgcgtaacggcaaaccactggaagtagaagtgacgctcgataccagcacctcttcgtcggccagcgctgaaatgatcacgccagcgctggaaggtgcaacgttgagcgatggtcagctaaaagatggtggcaaaggtattaagatcgatgaggttgtcaaaggaagcccagctgctcaggctggcttgcaaaaagacgatgtgatcattggcgtcaaccgcgatcgggtgaactcgattgctgaaatgcgtaaagtgctggcggcaaaaccggccataatcgccttgcaaatcatacgcggcaatgaaagcctctacctactaatgcgttaatgtcgtaaaccgggcatcaggctgacgtgtgatgtccggttaactcgtggtatgctgctgccgttcccttttttaacgatgcctccatcatgtttgtgaagctcttacgttccgttgcgattggattaattgtcggcgctattctgctggttgccatgccttcgctgcgcagccttaacccgctttccactccgcaatttgacagtaccgatgagacgcctgccagctataatctggcggttcgccgcgccgcgccagcggtggttaacgtttataaccgcggtttgaacaccaactctcacaaccagcttgagatccgcaccctgggatctggtgtaatcatggatcaacgcgggtatatcatcaccaataaacacgtgatcaacgacgccgatcagatcatcgtcgccttacaggatggacgtgtttttgaagcgttactggttggctctgactctctaaccgatctggcggtgctgaaaattaacgccacaggcggtttaccaacgattccgatcaatccacgccgcgtaccgcacattggcgatgtggttctggcgatcggtaacccgtacaacctcgggcagaccattacccaagggattatcagtgccacgggtagaatcggtctgaacccgaccgggcggcaaaacttcctgcaaaccgatgcttccattaaccacggtaactctggcggcgcgctggtgaactcgctgggcgaactgatgggcattaacacgctgtcgtttgataagagtaacgatggcgaaacgccggaaggtatcggctttgcgattcctttccagttagcgaccaaaattatggataaactgatccgtgatggccgtgtgatccgtggctacattggcattggtggacgtgagatcgccccattacatgcgcagagtggcggcatggatcaactgcaagggatcgtagttaacgaagtgtcgcctgatggcccagcggcaaatgcaggcatccaggtcaacgatctgattatctctgtgaataacaaaccggccatctctgctctggagacgatggatcaggtggcagaaattcgccctggttcggtgatcccggttgtcgtgatgcgtgacgataaacagttaacattgcaggtcaccattcaggaatatccggcgaccaactaaggtcagcgtaaaaaaacaaaaaccggagtctgtgctccggttttttattatccgctaatcaattacttattaacgaactcttcgcccagggcgatatctttcttcagcgtatccagcataccttccagcgcgttctgttcaaatgcgctcagggtaccgatagatttacgctcttccacgccgtttttacccagcagcagcggttgagagaagaaacgtgcgtactgaccgtcgccttcaacgtaggcacattcgacaacgccttgttcgccctgcagtgcgcgaaccagagacagaccaaaacgtgcagctgcctggcccatagacagggttgcagacccgccaccggctttcgcttcaaccacctcagtacccgcgttctggatacgtttggtcagatcagccacttcctgctcggtaaaactaacgccaggaacctgtgacagcagcggcagaatggtaacaccagagtgaccgccaataaccggcacttcaacttcgcctggctgtttgcctttcagttccgcaacaaaggtgttggaacgaatgatatccagcgtggtaacgccgaacagtttgtttttgtcataaacaccggcttttttcagcacttcagcagcaatcgcaactgtagtgttaaccgggttagtgataataccaatgcacgctttcgggcaggttttcgcaacttgctgtaccaggtttttcacgatgccggcgttaacgttaaacaggtcggaacgatccatacccggtttacgcgctacgcctgcagagataagaacgacatctgcaccttccagcgccggagtcgcatcttcacctgaaaaacctttgattttcacagcagtagggatatggctcagatcgacagccacaccgggagtcactggagcgatatcatacagagagagttctgaacctgaaggcagttgggtttttaacagtagtgcaagcgcctggccaataccgccagcagcgccgaggactgcgactttcatcctaaactccttattatattgataaactaagatatgttgctccgctgccgcgaccttaatccacaaaattgccgtttacaatgaccacatctcaagaatgtgtagtcacgcaagtttagcgtttatgcatttaattgccgtaatcaggaacctaacttacgtaattaacagtcacttatgcattagcgcaacattccaacaggtggtgacaatataccctaccgctcagccaaaacaatatcaatttgataacaattaatttacttttaagcagaatttgcaggccgtgacgcaggcatgtttctcaataacgaaatttgataaaatcccgctctttcataacattatttcagccttcttcagggctgactgtttgcataaaaattcatctgtatgcacaataatgttgtatcaaccaccatatcgggtgacttatgcgaagctcggctaagcaagaagaactagttaaagcatttaaagcattacttaaagaagagaaatttagctcccagggcgaaatcgtcgccgcgttgcaggagcaaggctttgacaatattaatcagtctaaagtctcgcggatgttgaccaagtttggtgctgtacgtacacgcaatgccaaaatggaaatggtttactgcctgccagctgaactgggtgtaccaaccacctccagtccattgaagaatctggtactggatatcgactacaacgatgcagttgtcgtgattcataccagccctggtgcggcgcagttaattgctcgcctgctggactcactgggcaaagcagaaggtattctgggcaccatcgctggcgatgacaccatctttactacccctgctaacggtttcaccgtcaaagagctgtacgaagcgattttagagctgttcgaccaggagctttaatctctgccccgtcgcttctggcggcggggaaaatgttgcttttgcctatcaaccccctgctttcccctgcgattcatttaacgaatagtgcgttttactgcgacatatcattcacacaatgaatacacatagtaaaaaagcacattatgcaaaattcattatctaattgaaaatactataattaacaataaatgatcgtgtttttaattcttttttgttattaaaattcacatttttaacacttagtatcaactgaaacagttagcgtggtattaattagttcaataattagtgtatacttgattttgtgatatggatcacgaaacaaaggcccagctaaaagattatgtcgaggtaaaaatcatgaaaatcaaaaccactgttgctgcattaagtgtgctttctgttctctctttcggtgcattcgctgccgactccattgatgctgcacaagcacaaaatcgtgaagcaatcgggaccgtatccgtaagtggtgtggcgtcttcgccaatggatatgcgtgaaatgctgaacaaaaaagcggaagagaaaggcgcaacggcctaccagattactgaagctcgtagtggtgacacctggcacgctacggctgaactgtacaaataaaccctcatcgtcttgtccgacgatattgcccccggttcgggggctttttttgcgctaatgacgaacattaaaacgcaaatgcccttccagctcttcctctgcctcatcaaacagcaatattaacgcgccaaaacggcgacgcgttttctctcccagatgaacaaattcaatctcaagtggtagcggcaggacatcgttcattaactcatcccatagtgagtcgagatcgcgtaccttatctttcgccagaccaaaggtttggctaaagtcacgataaaaatcctcctgactctcaatctcatcaaaatcaaaggtataaatattcatctgttgccaccgtcacgtttcgcggcgagttctgccgttcatcgctaagtatagccatgaaaaaaccgacgcttcgggcgtcggctttgacttaactatcggtcaacgcatgttgatacttatgcagcatacccgccagccgatgaaccggttccgtcacctgcggtggcgcttgccagatgcgtagcttttcctggtagatttccagttcttccagcaactgtccaaaataccgacgacgtttatcatcgctacgggcagatatcacatggtctgctgtgcggcgcatttgtcggtgaaacgccgataaatcctcgttaatcgggatcggcgcatcacgcaggcgctggtgcgcgataatcatcgtcagcgccaggcgaaatttcggcaaatcccctgggaacttattcatcagcaaaaacagctgctgataaagtgccgggaggtgattctctttacgacgtgccacattggtagtcatcgcggaaacagcggcagaaacaaactgattaagcagtacacgtccagtcctgtcgcgcgatttatcccgcaccagcaaaataacggtgaacgcgagcacacagccgacgatttgccctaatgcgctgtcgagaaactgactgaaatggaaagtcatcgggttatccagcacgataatatttatggtgctggccagcgcccccatcgagcccagtcgccgtttctgtacttctataccgaggaagaatcccagcactgccaggctaatacacagcagcaacatgctctgttgagtattagggataatcaccaaaaagtagagcagccctaacggcagcgctgccagcgtcccgtagataaagtcgatcgccaccatgcgtggattcggcaaacgcattgccagtgacgtcactaccgcaatcatcaccattgcaccactaccggaagtccagcccgtccacagccagaaaagcgtccccagaatgcaggaaagtgtggttcgccagaagttaaccatcgcatgatgacgttcggctgactctactttgacttccggttcgccttgcaggatctcttcttcggtggcgttgatttttgtgttactgataacgccgcgcttgagaagctgataacgcgttgccgccgcgacccagctataaatggtgacaggcgtttcccgttccccggtccaggcgataactctccgcaggcgtttgagctgcttgtggacgtcctgcgcggtttctaccggcgtgtcaaaaaattcgcggaaagtatcagtgatcaattccgggcgcgtattctgaataagataagtttcgcaggattgggtaatcagagtcagcgatagcgtattgatcgcttttaaacgtcgattggcccgcgcccagcgggaagattccatattcaggttgctgcgcataccttgtaacgccgtggtgcgtcgcaccagatcgccccaggctttatcgacaacttcaccatcgccatgcttgatacagagttgcattaattgatattgcgcgaccagcaaactttccagctctcgatccacttcttgtttgatcgatcgcggagaaaagagcaaatccgccataattgcacacacaataccgataacgatctcgctacaacgttcgacggcaaactgcggcgtaagcaatggttccggctgaatggtgatcacaatgatcagcgcggtataaccggccagcccccacgcatacgagttttctattcgtaccagcgaggatatccaggtacaaaaaccggcccagatacagcacaccagaatcatcaataatggtgcgcggatcatcgcaatgatgattaccagtccggcaatacagccaataaatgtgccgatgatgcgcaaaaagccacgatagcgaatggcgccagaatacggttcacctcccgcagcaaaggccggaccggcggcaacaatcgccgctgtcagtaccgcccagcgtggcgtttccagctggaagtgaaagccaacaaacagcgccagtacaatggcggtcgccagttttaccgcaaagcgaatatgttgattagcaatggagaaaatacccatcgtgattaaccaaactcacgcaggcgatgagccattttacggaagaacgaatcctgactttcgtcgcgatcttgtttgccagtgactaccaccgtagcagtggtgcccgcaggccagatgttctcttgctggttgtcgagacgaatacgtaccggaacacgttgcgccaaacgtacccattcaaggttagagtcgatggtcgccatccctttgtcgtcacgcgtgctgctggcattggtgacccctgcggcaacactatcaacagtccctttcagcactttgttactgccaagcggcgtgatctccgcacgatacccagggcgcaccccttccagcttagtttcttccatataggccagtacatagaaggagttctgtttcaccagcgcaaccgccgttgatcctcgagtaataaactcaccggtatagacgttgaggttggtcacccagccatctgctggcgcgcggatgactgtacgttcaagatccagttttgccagatcgcgggtcgcctgcgctttcgctaactgatgcagaactgtttgtagtacgttgttggcctggtcgatctcttcgcgagacatcgcctgcacaccgagacggttacgacgtccggcctcctggcgtttctcctgcgccagtacctgataataagcaacatcggcttgcgcttcctcaagcgccttttgataacgcggctggtcgatggtgaacagtacctgtccttttttcaccagctggttatcatgaacattcacctgggtaatgagtccagaaacgtccggcgcgatcgcaacgacgtcagcgctaaagcgcgcgtcacgcgtccacggggattcggtgtaatagacccaggcattaaaaattgcgatgaaggccagaatgactaatacgaccgtgatggccgtacgggagaattttcttattagtgttttcacttcaacctcaaacgaacagtcgcgatatcaaataaaacaagcagcaatagagcgcggtgttgaacaacgccggatgccagacaaagtcgtaaatacctgttggcacaagtacccggcgcaccagccagaaaatcgccagtgataaaagcaattcgaaaaatatcggtgggaaggacagcccaaacaccacgataacgggaaacagactcatgttgaccttggttgtatagagagagcaggcgttattattttcagcatctgtcgccgcagagaagggcatggaaagccgggcgagagcaacattgctgtagattgatatttaatatattaacgtaactgttatgctgttatctatattatgtgatctaaatcacttttaagtcagagtgaataatggaacgactaaaacgcatgtcggtgtttgccaaagtagttgaatttggctcttttaccgccgccgccagacagctacagatgagcgtttcgtccatcagtcagacggtgtcaaaactggaagatgagttacagataaagctgttaaaccgtagtacacgcagcattggcctgactgaagccggcagaatttactaccagggctgccgtcggatgctccatgaagtgcaggatgttcatgagcaactgtatgccttcaataacacccccatcgggacgctgcgcattggctgttcttcaactatggcacaaaatgttctcgccgggctgacggcaaaaatgctgaaagaatacccaggtttgagtgtcaatctggttaccggaattcctgcccccgacctgattgccgacggtctggatgtggtgatccgcgtcggcgcgttgcaagattccagcctgttttcccgccgtctgggcgcgatgccaatggtggtgtgcgccgcaaaaagctatctcacacaatacggcataccagaaaaacccgccgatttaagtagtcattcatggcttgaatacagcgtgcgacccgacaatgaatttgaactgatcgcaccggaagggatctcgactcgcctgatcccgcaagggagatttgtgactaatgatccgatgacgctggtgcgctggctgacggcgggtgccgggatcgcctacgtgccgttgatgtgggtgatcaacgagatcaatcgcggggaactggagatcctgctgccacgttaccagtcagacccacgcccggtttatgcgttatataccgaaaaagataagctgccgctgaaggtacaagtcgtgatcaactcgctaacggattattttgttgaggtcggtaaattgtttcaggagatgcacgggcgcgggaaagagaagtaattaatattgtactgttacgttgtacaaacctgtgccaacgggttcccctcaccctaaccccagaggggcgaggggaccgttcgtacacggagaaggattaattatccttctgaaaatactgaaattattacgcagtaccgccaacagtcaggttatcaactttcagcgttggctggcccacgccaaccggcaaactttgcccttctttaccgcagacacccacgccgttatccagtttcaggtcgttgccaaccatcgaaatctgctgcatggtttcgataccggaaccaatcaacgttgcgcctttcaccggcttagttactttaccgttttcaataagatacgcttctgaggtggagaaaacgaatttgccggaggtgatatccacctggccgccaccaaagttcggtgcatagataccgtactcaacggattcaataatttcctgcggggtcgatttacccggcagcatataggtgttggtcatacgcggcatgggcagatgagcgtaggattcacggcgaccgttgccagtcggcgtcatccccatcaaacgcgcgttgagtttatcctgcatgtagcctttcagaatgccgttctcaatcagcacgttgtactggcctggcgtaccttcgtcatcaatcgccaccgaaccacggcgatcgaccatcgtgccatcatcaaccacggtacacagttctgaagccaccaactccccgacctgtccactaaatactgaagtgccacggcggttgaagtcgccttccagaccgtgacccaccgcttcatgcaacagcacgcccggccaacctgcgccaagtactaccggcatggtgcccgctggtgcagcaacggcagaaagattgaccagcgccatacgcactgcttcttttgcccacgcatccgcacggacttcgccgtcgagatcagcaaggaagaactcataaccaaaacgaccgccgccaccactggcaccgcgttcgcgtttgccatcttcttcgaccaaaacgctcacggaaagacgcaccagcggacgaacatccgccgctagtgtgccgtcggtggccgcaaccagaattaattcatagacaccactgaggctggcagtcacttcctgtacgcgcttgtccgcttcgcgggcaaccttatcgacgcgacgcagaatatccaacttctcttcacggctcatgctttgcagcggatctaccgaggtatataacgggctatgctctaccgcgcccagcgtctgtactttgccatcaccactatcacggacgatggtgcgcgccgcttgtgcactctgttccagcgccagcaggctgatttggtcagcataagcaaatccggttttttcaccactgattgcacgcacgccaacgccctgatcgatgttgtaagaaccatctttaataatacggtcttctaaaacccaggattcgtgatagctcgactgaaaatagagatcgccataatcaaggcgacgttcggccagttgaccgaggatcgcgaacaagtcctgatgtttcaggccgttcgccgctagcaattgttcacttaccaggttcagactcatcgtttttgctactcgttagttactgcagtagaggattttttacggctgccggatgcggcgtgaacgccctgtccggcctacggttatgttctggctcgttggcctttggcaacgattatcatatgagattggggcaattacgcgccctcgtcaaatcattgcgctttttctttgcgcggttgtcgcaacacttcgttgatttgcggatcgtccagcggacccgaaatgtgatagcgcaaaatggagactttgctccacagcggtcccagcactttactggcggcaaacactgccgcgccaacaatggggttaaccgcaaaggccgcagccacgcccaccgtcgcagaaatctctggtgcgacaaccgcttccatattcaggtcgcgacgtaccagatttaccgaccctttcatagcgatgtccgcttccaggccatccaccagcgtgtcgtcggtgtgcataacgccgtctttaatccacgcggtgctgcgaatggagtcaaaatagaacccttcgccaaaagtgtctctgaaatcaaaacgcagcttacgcatcagggcatctacgctcaataagcgcagcaattgcccggcatgtccggtattgatttcggtaatttcgcctttacccagttgagtatgaatgatgccattcaacgtcgcctcatctggctgccagggtgctttgcgccagtgtaaatcgtaatccacattaaatgacgactggcgtatgggcgtcgtgacaccaaaaaattctgcggcggcatcaattttctgcccgcgcagttttcctttcagcgaggttcgttcattccccggattgttaacccattcaccatcggcagtgagccgcgcaaaaccagtatcaatcagtccattagtcagcgttaacgtatcgccagaaatggtgatatcactgtcaatgcgaccgaatttttgcccccagaaccagcactctgcgcatcgtatttgtgcgtctggccagccacggaagttaatgcgttccgttgtcgggaaaggtgatgactgtgttgaatcaccacgagttttcgccacgcttgggttgtaataaagatatttgatattcgccagccacggtgcgttattacgcatcgccagcgtggcgttgatttcacgcccttgcgcctcaaccagggtgccatttgccgtcggttgcgaaacaatactcaggttattccattgctgatttcccagcgacaacataggcgtacgtaacgttatgtgttgtgggaaactcgctgcaccaccgacactctccgccgcgcctttctggaacagggccagccactcggcaccattcatcggcggcatattgagttcaacgccactttgttccggcaacggcgggagcgttttactgtctgccgcccaaatagcacgatcgagcgtcagcttttgaccgagcaaccagcagctattgaaatggttatccgcaccagcctgtccggttaattcaaagctgttgagattgccatcaaccttaacgtttaccggtagtggttcacccgcaggtttggctaacggtgaaggtaagtgactgcttacattcttcagatcgccgttcagctctacgttatacgtcgcgccagcatgataaggcagctcaatgcccactttaccatcccacgccacgctgccacttaatgcttcgttcaccgctgcaggcagaaagccggttttcgctggttgccagttaccgttgagattcaccgcgacctggtaggcttttgccccttctttggtggaaaaatccacgttcaacggctgattaaaccagcttgctgtcagtggttcactttgcagatcgccattgataaagctgaatttaccgctcaaatttttcagggtgctgtcgagtggtttgataaacagactgttattacgcagcgtcacttcacctttcgcggttaccaactcgccgttcagcgggatatcaagatgtaagcgagcattcacatcgccgtcgagctggagttcttgcagggtcgcacccagggaatctttcagcggtgtctcatcaaagtaagggccaacggctttacccggacctttaatgtcagcgtcaatcagcagtttttcttttgagtagtcagggagcactgcggtgagattactcgcgcgcacgccgcccagattaacgccatcggttttcatccataaaccgtcgttaataaagtccagttcaatatcaaggttagttaatgcaggccagtccggctggaaggcaaacttcgcgttgcgcagcggcaccagcacttcaaactgaccttcgttgtgtttataggggaagagttgcggattgccaccataaaccagcgtcgcgttatccgcttcaccgccctgaatcgcgccacttaagtaatcaaccaggtctttacccatcaagttttccgggaaatagcgccaggcttgtgaaccatcatcggtactgatgccagccagaatacccagccagggttcatcgttagcaggttgcaggtaacgaaaaccgccgcgcgcatggacggctttggctttaacgtcaatattacgcccatccagctggaaacctttgtcattgttcagccagcttatcgttgcctggccgtcggcgatttccagtggcgcacggaataccgtttcgtaaggcatctttgcctgcttcatcgacgcagtaagcaaaccattttctacgctgccggaaagcgtcccggagaagtgttccgcacccggtaataatttccattgcttccaggccagatcgctccacgatgcctgaaaacgggtcttgtctgccgcctgaagcgggatatccagcgccagagtgttaatcttgccgctcggttgtgtggagcgccaaacatcacccagtgcaggtgaaagtttcgcgaccagcgggcgtacgccctccaggcctgccagctccagattactggcacgaatccggagttcgtcactgcgtttattgtctttgccgctaacgtcctgttccggtatccaggccagcgtcaatgctccgctcggccagggtttgccgtccatcgtgatccgtgtatcgggaatagagaactgccatcccggattttcacgcgtaatatgcgcagtcagattatccaccgacagcgtatgtgtttccttctcgcccaaccagctggcaccgccctgtttcagccagacgtcaccgccggttacatcgcctttgtcgatcgtcatccagccttcaagggagaactgtgccgtttccagcgcaatattgtcctgcatccatttaccgagccacggcttcaggtcgatgtcatccgcctggagccagacgcgaccattgcttaacaacccctcatcatcgcgcaaatccatacgcacctgcatcacgccgtgctgtccggtaaggctggagaggcttaccaggccttccgcacggtgtcgacgtggatcgttcagccaggtgagctgtgggatcgccagctcggcgcgctgaccggatggcgtcaggaaactgacttcactgtcgcggagatcgaaatggtcaaattgacgaagaaacagatcgctgatgtgactggcttccaggctatcattaccaccgccgctggtgataggagtgttggtgcgaaaacgcagctgccagaaagtgaggtcgcgaaactgccagcgcatatgtaacaggctctgccagacatccagcgccagagtaacgcgtttaaccgaaaattcgccgccatcttttagttctgcacggatgtcgtgcgcttcaagcgtcggaccaaaattctgccagctggctgagagctgactggcttctaccggcatgccagtcgcggattctattttgttgaggatttccggacgccaggcgtcaagatgcggtaaagcaatacgcaggccgctaaccagcagggcagcgatcacaacgagcgcggctccagtaagcagtaaaatccccggcaatcgcctcacccgtcactccttgtctgctaaaaatgtgactcaaaaaccctttgccggatggcggcccagcatctgtttacatcattacgacgtcaaactgctcctggttatagagcggttcaatttgtactttaacctgtttgccaacgaaaatttccacttccgccagcgagtgtgactcttcgcctttcaaggcttcggctactgccggagaagcatagaccaggaaacggtcggagtcgtaagcatggtggacacgaacaatctcgcgcatgatttcatagcataccgtttccacggttttcaccgttccgcgaccgtggcaggttgggcattcgttacacagtacgtgctcaatgctttcgcgggtgcgtttacgcgtcatctccaccagccccagcgccgaaaaaccattaacgctggttttcacccgatctttgctcagcgcctgctccagcgagtgcagcacgcggcgacggtgatcttcattattcatatcgatgaaatcaataatgataatcccgcccagattgcgcaaccgtaactggcgagcgatagcctgcgtcgcttcaatattggtattgaaaatggtgtcgtccagattgcgatgaccgacaaacgctccggtattgatgtccacggtggtcatcgcttcggtctggtcgataatcagataaccaccggatttcagttctactttgcgttccagcgctcgctgaatttcgttttcgacatcaaagagatcgaaaatcggctggcgtccggtgtaatgctccagcttgctggtcatctcgggaatgtactccgaggtaaactccagcaatgcttcgtaagtcaggcgtgagtcaacgcgaatgcggtcgagttcggcgtcggcgaaatcacgcagaacacgctgcgccagcgccagttctccgtacagctgataacgggtctgcgggcgttttttacgctccatcactttggtccagacgcgtttcagataagcggcatcggaggccagttcagcctcgccaaccccttccgctgcagtacggatgataaacccgccctgctcgtcgcaatactctgcgaccacttttttcaggcgttcacgttctgattcgctttcaattcgttgggataccccaacgtgagaagcccctggcataaacaccagatagcgagaaggtagcgtgatatcggtggtcaggcgcgcacctttagtgccaagcggatctttcaccacctgcaccatcagatcttgcccctgacggaccagttccgagatgtcgcgcaccgtgaattgcttttgttcttcacccgccacacattcagtgtgcggcatgatgtcagatgcatgaagaaacgcggctttatccagcccaatatctacaaaagccgcctgcatacccggaagtacacgacttacacgacccttgtagatattgcctactattccgcgtcgcgcctcacgttcaatatgaatttcctgcagaataccgccatcaatatacgccactcgcgtttccgaaggcgttacgtttaccaacaattcagccgtcatgtttatcccttttctcacgcagtgcgttaaaattacttaataattcatacgtttcaaccagcggtaagccgactacggcgtgaaagctgccatttatcttcctgacaaaacagccacccagcccctgaataccgtatgcacctgctttatctaacggttcgccgctggcgacatagcccgcgatgtcttcgtctgttaacgttctgaaagtcacatcggtgaccaccaggcaatcgagaatgtgctggctgtcagccaacgccactgccgtcatcacctgatgggtctgacccgataatttgcgcaacatctgcgccgcatgctctgcgtcgcgcggtttctcgagcacttctccgttcaggataacgatagtatccgcacccagcaccgggagatcctgcgccgtttgcgcgacacccgcctgtgctttctcgcgcgccagacgcacaacatactgctgcgcgctctcctgcggctgacgctgctcctcaatgcccgtaacaatacgttcaaaggtcacgccaagttgcgcaagtaactcctgacgacgcggagaaccggaagctaaatacagagaagtcatagaaacctttattgcactgcaaactgctgacggactttacgcatcagcaagaaaatccacggccagagcaccccattgactacactactccagaacacttccggtctgaaagagacgttaatcactaaaaactctgcccagaaaacaataatatccaccaccagcgaaagcaacatgacgaccagcgcctgctgccataatgcgaggttgcggaaaagctggtatttcagcgccaccaggtaagcaatgatgctcatcgccaatacgcgtacgccaagcgtcgagccgctgatcagatccagtatggcacccatcacaaaacctgtgcccacatttacgcgatggggcaaggccaggatccaatacaacaagatgagtaacacccagtttggccggaaaacaatcaggttatccggccagggcatgatttgcagcaacagcgcaatgaggaaagagagccagattacccagcgtccctggctacgatagctcgccactattgtcctcccggcgcacgcgcaggcggttgagcaccactttgcggcggcgtagccctttgtggagagcgattagcagcgggctgtgtgggcgcagcaggcgcagtaactgcatttcctgtcgccggttgctgcggagtcggctgagtgatccctgttgccggttcaggtaactttggccccatcgcgtctggcgaaggcaatacctgcggcatcatctgcatcaaacgttcattagcaacacgatgcacctcttccggcgtcatcgggttagcgccgttacgatccgcgccccacagcagcagcagataacgcaaacgttgcagtcctgcagtcggacgcgcctgaatcacagtataagcgcgctgggtatcgagttttacggaagagacaaccgcgaccggatagccttccgggaaacgaccgcccagaccggaagtcaccagcacatcaccaacacgaatatccgtattcgctggcagatgctcaagctgcaaatcatccgtacaaccgttaccggctgcaattacgcggatatcgttgcgcagcacctggattggcagcgcgtgggtcgcatcacaaatcagcagcacgcggctggtcagtttagcgacggccaccacctgaccaacaacacctttgtcgctgataaccggctggccttcataaacgccattaacgctacctttatcgataacaacttgatcgctataaggatcgttaaccgtggagataacctgagtcaccattttctgctcatcctgacgcagcggggaacccagtagctcgcgcagacgcgcgttctcctgtttgtattgtccaagcatcagcagttcactgtttttcagcaacagttcctgacgtaacgcccggttttcaagttctagttggtcacgcgaggccagcgtctgcgatacgccatccagcaattcacgaggagcattggaaacaaagtagaaaggactgacggcggtatccatataagtacggatttgactgaacgtccccaggcggctgtcggcaataataatgccgagcgccaccagcaccgccagaataaggcgaatctgtagcgacgggccacggctaaaaattggcttcataagttatgcgtattctcgtatcagaccaggcagggtaaacagacacttcccctgcctgcatccgattactcttcgctgaacaggtcgccgccgtgcatgtcgatcatttccagcgctttgccgccaccgcgcgccacacaggtcagcgggtcttcagcaacaacgactggaatgccggtttcttccattaacaaacggtcaaggttacgcagcagtgcgccaccaccggtgagcaccatgccgcgctcggagatatcggaagccagttccggcgggcactgttccagtgcaaccattaccgcgctcacaataccggtcagcggttcctgcagtgcttcgaggatttcgttggagttcagggtaaaaccgcgtggaacaccttctgcaaggttacggccacgaacttcgatttcacgtacttcatcgcccgggtaagccgaaccgatttcgtgcttgatacgttctgcggtggcttcaccgatcagagaaccgtaattacgacgtacatagttgatgatagcttcgtcgaaacggtcaccaccaatgcgcacggaagaggagtaaaccacgccgttcaaggagataacagcaacttcagtagtaccaccaccgatatcaaccaccatagaaccggtcgcttcagaaaccggcaggccagcaccaattgcggcagccatcggttcttcaatcaggaagacttcacgggcaccagcgccctgcgcggattcacgaattgcgcggcgttcaacctgggtcgcgccaaccggcacacaaaccagaacgcgcgggcttggacgcataaagctgttgctgtgcacttgtttgatgaagtgctggagcattttttcagtcacgaagaagtcggcgataacgccgtctttcattgggcgaatggcagcaatattgcccggcgtacggcccagcatctgcttcgcgtcatgacctactgcagctacgcttttcggtgaaccggcacgatcctgacgaatggccaccacggaaggctcattcaatacgatgccttgtccttttacataaatgagggtattcgcagtacccaggtcaatggacaagtcattggaaaacatgccacgaaattttttcaacatactaagggataatcctgaaagctggggcggaaaagaaaatccgcttactttaccaaccacacgcagcagcgacaaggcgcaaaaatcatctgctacggtgaaaattagtgcagttcgtttcctttgttacaaatctctgcctgagtccagaaaggcttaatgcatcagcagcattcctcgcctgtttgcaaccgcgtaaggtcattcatctgcatatgtgctgcaacaatctggcgagcagacaagcacactcccatgagacgcagcgcgcgttattctacgtgaaaacggattaaacggcaggttaaaccgagtatctttgtgaatattttttcacgttagtatcaagtggctgtgaggacgcgaaaaaatccccttgcccacctgtaacaccgcgctgaatcagggtctgccactcgcttcgcgaacgcacgccggtggcgtaaacctgggtgctggtcccggagcaggcttccaccaggctttgaaccagcagttggttctccgttcgcttctcaatgtttctgaccagccccggatggagcttgagtaactcaacattaagttctttgatccaactggtgcttaccagcgtcaaaccagcctggttgacggctacccgtacccctaaagcattcactaaacgaataacaggttgtaagcgactgatatgttgaccaacatcggcctctgcaagttcaataattatgtgtcttcgttgcgatttttcacattgcattaacgtatcgcgcagccaacgctgaaaacgcgggcgaatcagcgactcaacggtaacctgaatcgccagattttcctctggccagtaacgcaatagtggaataagacggctgatttgcaggcggtcatactcttccgataaaccaaactgcaagaccatcggcatatactctgccgagctaacctcttcattaccatcgaaaatgcggcacatgagttcacgatgataaacccggccttcgcgagtaaccgccggtttttgataaaggcgcgggccgccgcgactgagcatttgctcgataagcgtacgccagcgaacattaccgcgtcctttttcaggcaacgagtcatcgtaaatagcccagctattgccgccctgcaatcccgcattacgcgtggcagactctgcatgttccattacctgctcggtatcctgaccactacgccaggcacagataccaatgtggatcatatcgtcgcgatcgagcattttattgttcggcaaggtatcgacggctttgattaactgactggcgatgctctctgcctcttttaacgtccggtgcggtaacagcgcagcaaaatcactgcggtggtaacgcgccagcagtgcgccagggtagcgcatcataaatgtcgatagcagattcgtcagagagaagaactgttcttcaacctggctgtgcccccaggtatcactcaacatattgaaatccggcagacgaatcatcatcacgatcccgtgggtacctactttctcttgatcttccagtaacgttgctaactgattatcgaaaaagagtcggttattgaggccggttttcatgtcctgggcggcataagagcggatcagcgtatcaagacggctgtgttgttcgcgtgcgttctgaatttcacaaagcagcgtatccagcgcactgctggttctgggcggccattcatagatggttcccaacacattagagccacgctcaccgtttaagatacgagtagcccgggtttccagcaattcttgcccggcaagttgccgttgtaaccagcgtaccgccaggaagagcataagaatgataaagccaatcgcccccgtgagcggcgcggtagtcattaaagaatggaaatagttgcccatcggatcctgataaaccagacgcagcgacatccccggatgctttatcaacggaacgctcagttcacgaaacagatcgttggtgccaaccggacgataactaccatttctggccagggtataaacctgcttatcaccatggagcaggtctacacgaacgatatctgccgacatcattaattcggtaatttgtggccttaatgtgctgaagtcattcgacactaggtgggtatcaatcgccgtcgccaccgcctgaacacgatgactaaacttatactgaatggcgttgtagaaacttagcgaacagcccagcaaagtcacaaaaattgttaacccggtgagcagcgtgacaaaggccgaaaatttcgtcgttaatctcatccttgtgttaactccgatagtgaggaagcgggcatactagcaaatcagatttatctcgcaatttattgcgcttcatcggctttgcttttccattagcgagtatagtcttcagaaattattttccaatccatcatgcacatgaggaccacttatgcaggcgttacttttagaacagcaggacggcaaaactctcgcatcagtacagactctggacgaaagtcgcctgccggaaggcgatgtcacggttgatgttcactggtcgagcctgaactacaaagatgcgctggcgattaccggtaagggaaaaatcatccgaaattttccgatgattcctgggattgattttgccggaactgtacgcaccagcgaagatccgcgttttcatgccggtcaggaggtgttactcactggctggggcgttggtgaaaaccactggggtgggctggcggaacaggcgcgagtgaaaggtgactggctggttgccatgccgcaagggctggacgcgcgtaaagcaatgattatcggtactgccggttttaccgccatgctgtgtgtgatggcgctggaagatgccggtgttcgcccgcaggatggggaggttgtcgtgacgggtgccagtggtggcgtcggcagtaccgccgtggcgctgctgcataagttgggttatcaggtcgttgccgtttccggtcgcgaaagtacccatgaatatctgaaaagtttaggtgccagccgtattcttcctcgcgatgagtttgctgaatcccgtcctctggaaaaacaagtctgggctggggcaattgacaccgttggcgacaaagtgctggcaaaagtgctggcgcaaatgaattacggcggctgcgtggcggcctgtggtctggcgggtggttttactctgccaaccacggtcatgccatttattctgcgtaatgtccgtttgcaaggggtggattcagtaatgacgccaccagcacgccgcgcacaaacctggcagcgactggtcgccgatttaccggaatcattctatacccaggcggcaaaagagatatctctggcagaggcaccgaagtttgccgaggccatcattaataaccagatccagggtcgcacgctggtgaaggttaactaaccatttagcagtgaataataagagagggaactcattttgaaatcattattcagtcggttaacgggaaaagcggttagccggacagcttttgtcgaacatcttggtcatgaagttgtacaacatcatccaaactggaaagtcatgatttcgactgaccacaaattgatgcgcattgatacggggcaccaaacagccattattgatacgcctccgtcgcctgttaggtttatggtgctttgccttggcgacgctacgcttaatctgttactgatttctggtaccatggggggaataatctgattttatttgattacaaattaaccacttaaacctattgaatgcggaacattgtgagtcggttaattttgcgtgctttagcattcacatctttccggacgatgcagtgaaaattgggtaatccccagcaaccgctgcgtaatgtcgtctatcttgtcgcgatcctggcatccctacattatttgtggtctgtgaagattatctcattgcagccccccatcttcgcagggctggctttacagcttttcaccttacgttataagaagttccgtcgatgatggcgctaatttcgtgaattgtgcggcttgttgcaaattacacggtgttgaaggttatttacatgttagctgttgattatcttccctgataagaccagtatttagctgccaattgctacgaaatcgttataatgtgcgacctcgtcctccctgacgcagtttttgcgctgcggaaaaggtgacattggcgcaacgaaggtatattttgttttttgccggaggatagcagcagatcgctgcacaatgtccgtcaagtctaacattgacactctggggcaaaatagaccggcgtcccggcctgctggaatttatcgctatgcatacagctgtcggggcatacgctttacagacggctgtgaaacgcctgtcacaatcacactaaacaaagagtacggaacccactcatggatattcgtaagattaaaaaactgatcgagctggttgaagaatcaggcatctccgaactggaaatttctgaaggcgaagagtcagtacgcattagccgtgcagctcctgccgcaagtttccctgtgatgcaacaagcttacgctgcacctatgatgcagcaaccagctcaatctaacgcagccgctccggcgaccgttccttccatggaagcgccagcagcagcggaaatcagtggtcacatcgtacgttccccgatggttggtactttctaccgcaccccaagcccggacgcaaaagcgttcatcgaagtgggtcagaaagtcaacgtgggcgataccctgtgcatcgttgaagccatgaaaatgatgaaccagatcgaagcggacaaatccggtaccgtgaaagcaattctggtcgaaagtggacaaccggtagaatttgacgagccgctggtcgtcatcgagtaacgaggcgaacatgctggataaaattgttattgccaaccgcggcgagattgcattgcgtattcttcgtgcctgtaaagaactgggcatcaagactgtcgctgtgcactccagtgcggatcgcgatctaaaacacgtattactggcagatgaaacggtctgtatcggccctgctccgtcagtaaaaagttatctgaacatcccggcaatcatcagcgccgctgaaatcaccggcgcagtagcaatccatccgggttacggcttcctctccgagaacgccaattttgccgagcaggttgaacgctccggctttatcttcatcggcccgaaagcagaaaccattcgcctgatgggcgacaaagtatccgcaatcgcggcgatgaaaaaagcaggcgttccttgcgtaccgggttctgacggcccgctgggcgacgatatggataaaaaccgcgccattgctaaacgcattggttatccggtgattatcaaagcctccggcggcggcggtggtcgcggtatgcgcgtagtgcgcagcgacgctgaactggcacaatccatctccatgacccgtgcggaagcgaaagcagctttcagcaacgatatggtttacatggagaaatacctggaaaatcctcgccacgtcgagattcaggtactggctgacggtcagggcaacgctatctatctggcggaacgtgactgctccatgcagcgccgccaccagaaagtggtcgaagaagcaccggctccgggcattaccccggaactgcgtcgctacatcggcgaacgttgcgctaaagcgtgtgttgatatcggctatcgcggtgcaggtactttcgagttcctgttcgaaaacggcgagttctatttcatcgaaatgaacacccgtattcaggtagaacacccggttactgaaatgatcaccggcgttgacctgatcaaagaacaactgcgtatcgctgccggtcaaccgctgtcgatcaagcaagaagaagttcacgttcgcggccatgcggtggaatgccgtatcaacgccgaagatccgaacaccttcctgccaagtccgggcaaaatcacccgtttccacgcacctggtggttttggcgtacgttgggagtctcatatctacgcgggctacaccgtaccgccgtactatgactcaatgatcggtaagctgatttgctacggtgaaaaccgtgacgtggcgattgctcgcatgaagaatgcgctgcaggagctgatcatcgacggtatcaaaaccaacgttgatctgcagatccgcatcatgaatgacgaaaacttccagcatggtggcactaatatccactatctggagaaaaaactcggtcttcaggaaaaataatttgtgacgcgcggtgtttccatcgcgcttagcaaagaacgtaatcaacgccgggcctgttaatgctacccggcgtttttattgccgttaactaacggtagcctgcaatttccgctttcaacgcgctaatttcagcatcgccatcaacaattcccagctcaaagcagtatttctttgtttcccctggttcaataaagggcagacgcccctgcgctcgttctttatcacgaccgtcaagaaaactattactgacctccagtcccataacatattcacccgcgcctaaatttttccactggataaagttgggtagctgcatgatgtcgaatttctcgtaaattccccaccccagttcggcgttcaccagcgcaactttactcatcccctgactgtcgctattcaacgtgagatagtaaacctgctcgtcaaaaccgggctgtggggtacaaatctccagatgactggctaacccttccgccgcatgcggggttcgtggcgttacgcttttagccgacagcaaaatttctgcctgtggcgataataaaggccagccgtaattaaagtgataaagaatttgcagcggctggcgggtgaaaccatgattagtcaccttgtcttcaatgcgcagcacattttcgccataacggcagcgaatggtcctttccagcgtcagattttcaccgaacaatcgtgtttcccgtactttgccattgatgacaaattcaatgctgtcgtcggtccgttctgtgcgataccccacctcttctgctggagtcgcagccaaacgcccgtgtaaccccagcgtttctccttcatcctcacagggcgtgccaatgtagctaagtccgcaggtagtcagtaaccccgcgtaaaagctacgtaaaaacccgttgccctgagactcaaaaaaagcgggggcgacaacaccgttgggggtgataaaagagagcgcagtgtccttgtagctggcccatgcaatatccagcgcgcgatcttttaccaccgtaaatgccagtcccgcaccagtacggacatcaaacgcttctgtaccctttgctctgccactacgtaactcatagtgtttaattccggcaacctgcgagagatcgccaatccacgaccaaatttcgcttttcattgtgctgcttcccgaatggacatgtcatggcgctggatgaacgtttcgatttccataaggcgagacgttccctccattgggccacgtcgggttaccgccagtgcaccgcaggcattggcatattgtaatgcccgatgggcgtcaaaccctagctggcggcaggcaatccatgcgccaccaaaacagtctcccgcaccggtcgggtcaacttcttccaccggatagctctcaacatgaaactgctcattcgcggagtagtaactggctccttgattgccgcgcttcacaatcacctctttaacaccttcttcaagaaaaccagcgattgcacgctccggtgtcgagtgtggcgacaagagcaacacttcgccctcgctgggcatgtagatatctgttaactcaagaacaaagtggagggcatcacgcatttctggaatatcgagcatctctttacgaatattcgggtcgaaagaaataacgccaccatttgctttaacgatggttactgcttttttaactgcgtctaccatatggaatgaaaacagggatgaacccataatatgaaaatgggtacaatccttcagaatattttcatcaacatgctgtgccgataatttaccgcaagcagcattcttgatattaaaaataaaatcgcgatcgccagagttatgataagtaacaaaggcactaccggtggcttccagaggtaagactgaaatccccctgatgtccacaccgtcagcagccagacgatgtatattaatatcaccaaagccatcattccccacgcagctaatgatgccgcacggaacgccaagacgtgtcacctggtcgataaaaatagcgggcgcaccactgggataagggccgttccagatacctggttgatcaaatggctggccgattttactcgccataatttcaaccagaatttctccaattgtgaagaccttactcatatgattaattccttgaaatgattagctgcgttttcttttatttcttacgtcaaaataaacggctacaagaatgactaatcctttaaccaccatctggtaaaaataaggaacattcattaagttcatgccattattaataacgccgatggttaatgcgccgatcaccgtccccaccacggttccatagccgccattcaggctggtgcctcccagtacagccgcggcaatagcatccagttcgtagctcaacgcggaattcggttgcccggaatagaggcgtgaggcaaggatcatcccgctgatacctgccagcacggctgtaatcataaagactttaattttcaagcgggtgacatttatccctgaataaattgccgcttctttattaccaccagtgatataaatttttcgtccaaaggttgttttagtaagaatgaagtggtttatcagcaataagatgattaatatccatataggaataggtatatagagaaattctccattccccagcgccagaaaagcatcatctttaatcatgatgggcataccatcggtcactatataagcaataccacggaagatccccatagtagcaacggtgacaataaacgaagggatccccgctatagccgtcaagccaccatttatcatccccaaagccagtgctgcaataatggataatgggaccaataaaacaaatggaattccccatgaagccccaagcgcagcaaatgtgccaatcaatgcaatggttgaaccgaccgataaatcaatatcgccaagcaaaagcacataagtcattccataggcggtaattgcaattatcgaaacctgaagaataatattagtaatgttattggcggtaaaaaaactgtcattaataaaactgaacagaatgattaacaccaccattccactgaggataccaccatattgcctgaagacttttttaaaattatttgcaatgggaatttccgaaggtttcggactggcaagagttttctctgtcatttaacgtactcctgttgcagcggtcattacctgtgtctgcgttaaattttcacatgaataaatatcggcaatcgttttattacgcattaccaccagacgatcgctaagtgccatgacttctggcagttcagaggacaccagaataattgctgtccctgccgcagccagttgacgtatcacgttatagatttcaaattttgcgccgacatccactccgcgcgttggctcatcgagcaataaaatacgcggagttttctccagccacttcgataacacgattttctgttgattaccgccgctcagtgctcccactgcctgatgcacagaactcactttagtgttcattctggcaattgattgcagcgtcttcgcctcttcttgtcggtgattgatgagtcccatccgcgaagcgttatattgaaacgccacatggtgcgtgttcatattgacgtcgtgcatcagcactaacccttcttccttgcggttttcgatcacaaaagcaatgccatgatcaatagcctgtttgggattagcgatcctgacttccttaccatcaatcaacacagtcccgtgatacgaaacgaggccaaatagcgccttcatcacatcggaacgcccggcccccaccaggccaaaaaatccgaggacttcccccggacgcacagcgaaactgacctctttaaaaagcgaaggatgggaaagattttttacttccagttttgcaggaacattttcatccggtttttccccaagacgtgctggccaaatatttttcatttcccgaccaaccatttgggcaatcaagtgctggatatcactgtttttcttttcatgcgtagcgatatactcaccgtcgcggatcaccgaaatatcatctgaaatccgcataatttcatccatgcgatgagagatataaataaccgcacagcctcgctgctttaatttttcaataatgttaaacaggatctccgcttcattatcacttagcgaagatgtcggttcatccataatcacgacatccgctgcatagcttaaggctttagcaatttctaccagttgcctatgtgccatcgacatattgccgaccatttccagagggtctagtgggatgcccagttccgcgaggaggttctggcaatctgcgagcatttttttatcgttaattataccaaaacgtcgcggttcattattggcataaatattttccgccacggtcatattattactcaggctcagttcctgaaaaataatcgcaatccctaactggcgagaatgctgcggattattaatggtgatggtttcaccacgtagtgttatcgttccctgggttggcggataaacaccggccagtattttcattaatgtcgatttaccggcaccattctcgcctaataaagtatgcacccgccctttacgtaaagagagtgtaatatcttttaatgcctgaacatgaccaaatgtcttcgcaatatgcgaaacatcaagaataacatccgtcataatgacctcggtgtcacaacaaaacgccaataacgttttgttgtgaggtgaagatatttactatttacctgtataaacgccgggttgtaccgggatcattttttctaccggtttaccattgaggtgatcaacagcggcatcaatggctttagcccccatttgatcgggatattgccgaatcacggccgcaaacgttttttcactgtcaacggcatcacgcgcttctttcatgccgtcaaaaccaatgattttgatgttgtcgttatgcgcagattttgctgcgataaccgctgccagcgccgcatcatcaccaaagccaaacagaccattcaggttggcgtttgcctgcataatgttttgcgcagtcgttaacgcttcagcccgcgtaataccaggctgttcagcaacaattttaatatccggtgtatcgcttaaccctttcttaaaaccatcaacgcgcgcaaccaccgattgtagtgccggataagaaataatggctacagtacctttaccatgcaaaagtttacccattaacttgcctgcttcaacgcctcccgcatagttatcggtcgcaacatgcgatacgaccggaacgccttccgcagcgacgtcaacggtgataacgggaataccggccttatcggctttaattatcgctgcctggacgcctttcgaatcgaccggagagataataatggcatccacttttttagtaataaaatcctcaacatcagaaagttgtttgtttaaatcctgattggcaatagagacacttaaattgacattgtctttttttgcctcttctttcatggcattcgcaagatcaatatagaaaggatgttgttgtgttaataatgacgcacctattttatactcttttgccaacgaactttgcgagaacaatgccaggctcaccaacatagctgaaccaagtaatttaatatttttcataaacaatcctcattatttttgtagggtacaacgtcttaaatttttccttcactaccacagacgccaataatacgagttacgacttctttcatggcggcctttgcgggctgcatatagtgacgtggatcatttgccgcaggattgttgtagaaatatccttttaacgcatcggcaaacgcaattttcaattctgtcgcgacattcactttacaaataccgcgacgaatacagtgctgaacgtcctgttccgataagcccgaagcaccatgcaacaccagcggaatctccactcgctgacgaatctgttccagccgcacaaaatccagtcgtggttcatgcgcatataaaccatgtgctgtgccgattgctaccgccagggagtcaatttgggtacgttgaacaaactctgcagctgcggctggtgaggtataagcggaatctttttcatccacccgcagatcgtcctcctggccgccaagacgccctagctcggcctcaacgctaacatcaaagcgatggcaaaaggtggtaacttcttgcactcgcgcaatgttgtcttcaaatggcaaatgggagccatcaatcatgacagaacggatccctgcgcgaaccttgttaaaaatgtcatcactctcttcatgatggtcgagatgcaggactaacggcaggttgtactcgcgagccagcgattgtactaacgaaattaaacttcccacgccaccataacgatatgtaccgggtgttcccgccagcataacgggagagcgaagttgtgcagcgctctcaacaactacctgtaaagtttcaaggttatgaatgttgaaagcagggacggcatatccctctgactgggcttttttcagcatgtttttgcttgaaataatatacatcgcagctcctgttatttgtcgttcgccttacaaaatgaagaaagagaatctttactttcattttgaaagcaaactagcacagcaaaagcagcaaaaagcgtgatgcatgtcgaacatcatcaaaataacttacaaaaaataacttaatttatttttcactttgcaagtgaaaccaatggaaaccctgcataaatatgaatatattcatttatttttcaatgtattaagctattttcgttgcaatttttgacccctgattttcttttcgaattgtcgatatgattgaaggataactttcaaagaaaaatacaaggggctatagtgttacgcattaaaggccaatgaagagtgttaacgtgccgagaaaatcgtctaacctactgaaacgcagattaaaaattgcagaaattgttgccgcccagggtgaaatcaaagttgatgacttatctgcgcaacttggtgtctctggcgtgacgatccgcggcgatctcagttatctggagcaacagggatatttaaagcgatcatttggcggtgctattgcgacaccactctcctctgaaccagaagcgatacaaccgatcgcgccattgtctctggcacaacaaatggaaatagcacgacattgcgcacggttaattcgcgatcgtgacacgctatttcttggacatgggacaatctgccgtaagatcattccattgctcagcgaagtgaaaaaactgcgtctgatcaccaacgatcccgaacatgcgctgctggcaaatcagtttattgatggcgaaataatactggctggcagtgaaatgttgcgccccgacaccgcactggccggaaaacagcttgaacaggcacttcagcatttcaccattacacatagcattctggaaatcagccatctggatgctgatggtactttaaatatcaacgttcccagactcgccgctgcctggcagctctgtttcgatcatgcccagaataagacggttatcgttgccgccgatcctgcgccatcaacggctgctatcgggcatttgcatcaggcagaaaatgtgatcgtcagccgcagcattaacgaacaatatcagcaacaattgcagtcggctgatttcgttatcctttataccagtaatgagtgctttacctggtccaatcgcgaaaggcttcaggaatgagaggggttttgtgacaataactatctgcgctatgggcgaattgctggccgagtttttgtcccgcaacccacatcaaaaattcactcagcctggggagtttatcgggccatttcccagcggtgcgccagcaatttttgctgctcaggtggcaaaactgtcccatcgggccatcttctttggatgtgttggtaatgatgattttgcccgactcattatagagcgtctccgtcatgaaggtgtcattaccgatgggatccatgttatgaacaatgccgtcacaggtacggcgttcgtgagttatcaaaatccccagctgcgggatttcgtctttaatatccctaacagcgcctgcggtttgtttactgccgagcacattgataaggatctgcttaaacagtgtaaccatctgcatattgtgggctcatcgttgttctcatttcgcatgatcgatgtcatgcgtaaagcaataacgacgatcaaatcggctggcggcaccgtttctttcgatcccaatattcgcaaagagatgctgagcattcctgaaatggcgcaggctctcgattatttgattgaatatacggatatttttatccccagcgaaagcgaactccctttcttcgcgcgtcacaaaaatctgtcagaggaacagattgttagcgatcttctccacggcggcgtaaaacatgtggcgataaaacgcgcccagcgtggggccagctattacaagcttaaaaacggtacattacacgcccagcatgttgcaggtcacgatatcgaaattatcgatccaacgggtgcaggcgactgctttggcgcaacgtttatcactcttttcttatccggtttcccggcacacaaggcactgcaatatgcaaatgccagcggcgcgctcgccgtaatgcggcaaggtccgatggaagggatatcctcactggcagacattgaagactttttgcagcagtactgaacggcaattttctgtcagatcattttccctgcctgaagacttgccgtagaattgcccgtttctcgtatccccccatgaggaggaccccttccgtggacactcgttttgttcaggcccataaagaggcgcgctgggcgctggggctgacccttttgtatctggcggtatggttagtagccgcttacttacctggcgttgcccccggttttaccggctttccgcgctggtttgagatggcctgcatcctgacgccgctgctgtttattggactgtgctgggcgatggtgaaatttatctatcgcgatatcccactggaggatgacgatgcagcttgaagtaattctaccgctggtcgcctatctggtggtggtgttcggtatctctgtttatgcgatgcgtaaacggagcactggcaccttccttaatgagtatttcctcggcagccgctctatgggcggtattgtgctggcgatgacgctcaccgcgacctatatcagtgcaagttcgtttatcggcgggcctggagctgcttataaatacggcctggggtgggtattgctggcgatgattcagcttcctgcagtctggctttcgctcggtattctcggcaagaagttcgcaattcttgcgcgccgctacaatgcggtgacgctgaacgatatgctgtttgcccgctaccagagtcgtcttctggtgtggctggcgagtttgagtttgctggttgcgttcgttggtgcgatgaccgtgcagtttatcggcggtgcgcgcctgctggaaaccgcggcgggtattccttatgaaaccgggctgctgattttcggtatcagcattgcgttgtataccgcctttggcggctttcgcgccagcgtgctgaacgacaccatgcaagggctggtgatgctgattggcaccgttgtgctgcttattggcgtggtacatgccgcaggtggtttaagtaatgcggtagacacgctgcaaaccatcgatccgcaactggttacgccacaaggcgctgacgatattctgtcgcctgcctttatgacgtcgttctgggtactggtgtgctttggcgttataggcctgccgcatactgcggtgcgctgtatctcttataaagacagcaaagccgtacatcgggggatcattatcggtacgattgtagtcgcaatcctgatgttcggtatgcatctggccggagcgttaggtcgggcggtgatccccgatctcaccgtaccggatctggtgatcccgacgttaatggtaaaagtgctgccaccgtttgccgccgggatcttcctggctgcaccgatggctgcgatcatgtcgacaattaacgcccaactgctgcaaagttccgctacgatcattaaagatctctatctgaatatccgtccggatcaaatgcaaaacgagacgcgtctgaagcggatgtcggcggtgatcacgctggttctcggtgcgttgctgctgcttgccgcctggaagccgccagaaatgatcatctggctgaatttgctggcctttggtgggctggaagccgttttcctgtggccgctggtgctgggtctttactgggaacgcgccaacgccaaaggcgcgctaagtgcgatgatcgttggcggcgtgctgtatgccgtactcgcgacgctgaatattcagtacctgggcttccaccctatcgtgccctcgttactactaagtttgctggctttcctggtcggaaaccgtttcggtacatccgtcccgcaagctaccgttttgactactgataaataaagagttttaccatgccttggatccaactgaaactaaacaccaccggcgcaaacgcggaagatcttagcgatgcgctgatggaagcgggtgccgtttctatcacttttcaggatacccacgatacgccagtatttgagccgctgccgggcgaaacgcgcctgtggggcgacaccgatgtgattggtctgttcgacgctgaaaccgatatgaacgacgtggtggcgattctggaaaaccatccgatgctcggcgcgggcttcgcgcataaaatcgaacaactggaagataaagactgggagcgcgaatggatggataatttccacccaatgcgctttggcgaacgtctgtggatctgcccaagctggcgtgatgtgccggacgaaaacgccgtcaacgtgatgttagacccagggctggcgtttggtacgggtacccatccaactacctctctgtgcctgcaatggctcgacagcctcgatttaaccggtaaaacagtcatcgactttggctgcggttccggcattctggctatcgcggcgctgaaactgggtgcagcaaaagccattggtattgatatcgatccgcaggcgattcaggccagccgcgataacgccgaacgtaatggcgtttctgatcgtctggaactctacttaccgaaagatcagccagaagaaatgaaagccgacgtggtggtcgctaacatccttgcaggcccattacgtgaactggcaccgttaatcagcgtcctgccagtttcaggcggtttgctgggcctttccggtattctggcaagccaggcagagagcgtttgcgaagcttatgccgacagcttcgctctggacccggtcgtggaaaaagaagagtggtgccgcattaccggtcgtaagaattaaccttcgcatcaccgtatggcgacgcagagcgaagtgcgagcgatgtcacaaaaggcacgttaatttgccgattatttacgcaaatttgcgtgccaaaattttcattcataaagaaaaattgagaacttactcaaatttctttgagtgtaaattttagtcactactttctaatatgatgatttttatgagtaattatcgcgctacgctcattttaaatgcaattctttgatccatctcagaggattggtcaaagtttggcctttcatctcgtgcaaaaaatgcgtaatatacgccgccttgcagtcacagtatggtcatttcttaactcatgcgcatcggacaatatcagctcagaaatcgcctgatcgcagcgcccatggctggcattacagacagaccttttcggacgttgtgctacgagatgggagccggattgacagtatccgagatgatgtcttctaacccacaggtttgggaaagcgacaaatctcgtttacggatggtgcacattgatgaacccggtattcgcaccgtgcaaattgctggtagcgatccgaaagaaatggcagatgcagcacgtattaacgtggaaagcggtgcccagattattgatatcaatatgggttgcccggctaaaaaagtgaatcgcaagctcgcaggttcagccctcttgcagtacccggatgtcgttaaatcgatccttaccgaggtcgtcaatgcagtggacgttcctgttaccctgaaaattcgcactggctgggcaccggaacaccgtaactgcgaagagattgcccaactggctgaagactgtggcattcaggctctgaccattcatggccgtacacgcgcctgtttgttcaatggagaagctgagtacgacagtattcgggcagttaagcagaaagtttccattccggttatcgcgaatggtgacattactgacccgcttaaagccagagctgtgctcgactatacaggggcggatgccctgatgataggccgcgcagctcagggaagaccctggatctttcgggaaatccagcattatctggacactggggagttgctgcccccgctgcctttggcagaggttaagcgcttgctttgcgcgcacgttcgggaactgcatgacttttatggtccggcaaaagggtaccgaattgcacgtaaacacgtttcctggtatctccaggaacacgctccaaatgaccagtttcggcgcacattcaacgccattgaggatgccagcgaacagctggaggcgttggaggcatacttcgaaaattttgcgtaaacagaaataaagagctgacagaactatgttcgaacaacgcgtaaattctgacgtactgaccgtttctaccgttaactctcaggatcaggtaacccaaaaacccctgcgtgactcggttaaacaggcactgaagaactattttgctcaactgaatggtcaggatgtgaatgacctctatgagctggtactggctgaagtagaacagcccctgttggacatggtgatgcaatacacccgtggtaaccagacccgtgctgctctgatgatgggcatcaaccgtggtacgctgcgtaaaaaattgaaaaaatacggcatgaactaattcaggttagctaaatgcttgattaaaaaggcgctactcggcatggggaagcgccttttttataggtgtcacaaagggagtgaccatgagaacaggatgtgaaccgacccgatttggtaatgaagcaaagaccatcatccagggtgatgcattaaccgaacttaaaaagctccccgccgaaagtgtcgatctgatctttgccgacccaccgtataacatcggtaaaaattttgatggtctgatcgaagcctggaaagaagatctgtttatcgactggctgtttgaagtgattgcagagtgccatcgcgttctgaaaaagcagggcagcatgtacatcatgaatagcacggaaaacatgccctttatcgatctccagtgccgcaagctttttaccatcaaaagtcgcatcgtctggtcatatgacagttctggagtgcaggcgaaaaaacactacggctccatgtacgaacccatcctgatgatggtgaaagacgcaaagaactacacgttcaacggtgatgctattctggtagaagccaaaaccggatcgcagcgcgcgttgatcaattatcgcaaaaatcctccacagccttacaatcatcaaaaagtaccgggtaacgtctgggattttccgcgcgtgcgttatttgatggatgaatatgaaaaccacccgacgcaaaaaccggaagccttgctgaaacgcattattctcgcctcttccaacccaggcgatatcgttctcgacccgtttgccggtagctttactaccggtgccgtagccgtcgccagcgggcgaaaattcattggtattgagatcaacagcgagtacatcaaaatggggcttcgacggctggatgtcgcgtcgcattactctgcggaagaactggcgaaagtgaaaaaaagaaagaccggcaacctgtcaaaacgaagccggttaagcgaagttgaccccgatctcattgcaaagtaaaggaagtgtaagcctggttttcagattattcatttcgtgtatatttcctgccagacttggttaaacatgcacaggctcaggtaatgattcgcaagtattggtggctcgtcgttttcgctgtcttcgtttttctgtttgatactttactgatgcagtggattgaactgctggcaacagaaacagacaaatgccgcaatatgaactcagttaatccactaaaactggttaactgtgacgaactgaattttcaggacagaatgtgaatttatatgacacttaattcattcgttttatgaattaatttcgttatgttttcatctggcatgaacattcttaatacgttatcgaccagagcgggggcttgtttataaagatcataacccgccatattcattaaccagttttgaacaattccgctgaaggcaccatcaataataatcatcacaacatctaaatcgagattatttgctacacaaccttgttgctgacacgcctgcaatacttcgcggagagtctgcggattaaagcccatcttttcgcgtatcactccctcggccagcatctcatcattaaattcacatttgtgatataagattttcagcaacgcctgctggcggggaattttggcaatatattgcaaaccgacaatcaatttttcacgcaattgctgaaacgggtcatgctctaacccagcggtcaagtgatcctggattaactcccgcaatgaaggctgttgcaaccacatctcattaaacagttgagtcttgttttcgaagtgccagtagatagcgccacgcgtaacgttagcagcgtcggcaatgtcgttgagcgtcgtcttgcttacgccatgctgcgcaaactgggcgatggcagtttcaatcagttcttgccgggtcttcagggcttcagctttggttctttttgccatgattaattattcaggaaataaatatattcgacacaggataagaaaatagcgaaggttaatctatcacctaatgtgtatttatacgagaggctaatattgcgttgctataaatcgtcaaataaatgatatgtattatttacataaaatacattcacttgacctatacatatttcaatttacgagattttaattctatttctttcattccgcgtcaaaacaaaacagtagaatattaatctttttttgtgtttatgtgccttgagttgccagtattcataactattccttacatcgacgaatgataatttgtaggatagcgaactgtatttttctttctgcgagttaacgcattgcctttttgggcaaataacgcgcttttggttttttgaggaatagtaatgacgaaacatgccaggtttttcctcctgccctcctttattctgatctccgcggctttaatcgccggttgtaacgataagggagaagagaaagctcacgtcggtgaaccgcaggttaccgttcatattgtgaaaacggccccgttagaagttaagactgaattaccaggccgcaccaatgcttaccgtatagccgaagttcgcccacaggttagcgggatcgtactgaatcgcaatttcactgaaggcagcgatgtgcaagcaggccagtccctgtaccagatcgatcccgcgacctatcaggcaagttatgacagcgcgaaaggcgaactggcgaaaagtgaagccgccgccgccatcgcgcatttgacggtaaaacgttacgttccgctcgtgggtacgaaatacatcagtcagcaggagtacgaccaggccattgctgatgctcgccaggccgatgccgccgtgattgccgcaaaagccacagtcgaaagcgctcgcatcaatctcgcttataccaaagtgactgcgccaattagcggacgtatcggcaaatcgaccgtgaccgaaggcgctcttgtcactaatgggcaaacgactgaactggcgactgtccagcagctcgatcctatctacgttgatgtgacccaatccagcaacgattttatgaggctgaagcaatccgtagagcaaggaaatttgcataaggaaaacgccaccagcaacgtagagttggtcatggagaacggtcaaacctatcccctgaaaggtacgctgcaattctccgatgtgaccgttgatgaaagcaccggctccataaccctacgtgctgtcttccctaacccgcaacatacgcttttgccgggtatgtttgtgcgcgcacggattgatgaaggcgtccaacctgacgccattcttatcccgcaacaaggcgttagccgcacaccacgtggtgatgcaaccgtgctgattgttaacaataaaagtcaggttgaagcgcgccctgtcgttgccagtcaggcgattggcgataaatggttgattagcgaaggtctgaaatctggcgatcaagtcattgtcagcggcctgcaaaaagcgcgtccgggagagcaggttaaagccactaccgatacccccgcagatactgcatcgaagtaaggcaatctgacatggcaaacttttttattcgacgaccgatatttgcatgggtgctggccattattctgatgatggcgggcgcactggcgatcctacaattgcccgtcgcccagtatccaaccattgcgccgcctgcggtttctgtttcggcaaactatccgggtgctgatgcgcagaccgtgcaggatacagtgacgcaggttatcgaacagaatatgaacggtatcgataacctgatgtatatgtcctccaccagcgattccgccggtagcgtgacaattacccttaccttccagtccgggaccgatcctgatatcgcgcaagtacaggtgcagaacaaactccagctcgccacgccgttgctgccgcaggaggttcagcagcaggggatcagtgttgaaaagtccagtagcagctatttgatggtggcgggctttgtctctgataaccctggcaccacacaggacgatatctcggactatgtggcctctaacgttaaagatacgcttagccgtctgaatggcgtcggtgacgtacagcttttcggcgcacagtatgcgatgcgtatctggctggacgccgatctgctaaacaaatataaactgacaccggttgatgtgattaaccagttgaaggtacagaacgatcagatcgctgccggacagttgggcggaacgccagcgttaccagggcaacagttgaacgcctcgattattgctcagacgcggttaaaaaatccggaagaattcggcaaagtgaccctgcgcgtaaacagtgacggctcggtggtgcgtctgaaagatgtcgcacgggttgaacttggcggtgaaaactataacgttatcgctcgcatcaacggaaaaccggcggcgggcctggggattaagctggcaaccggcgcgaatgctctcgataccgcgaaagccattaaggcaaaaccggcggaattacagccattcttcccgcagggaatgaaggttctttacccttatgacaccacgcctttcgtccagctttctatccaggaagtggtgaaaacgctgttcgaagccattatgctggtattcctggtgatgtatctgttcttgcagaacatgcgggcaacattgatacccaccattgctgtacctgtcgtgttgttagggacatttgccatactcgccgcttttggttactccatcaatacgctaacgatgtttgggatggtacttgccatcggacttcttgttgatgatgcgatagtcgttgtggagaacgtcgagcgcgtaatgatggaggataaactcccccccagagaagcgacggaaaaatcgatgtcgcaaatccagggcgcgctggtaggtatcgcgatggtactgtcggcggtatttattccgatggcattcttcggtggctcaacaggggcaatttatcgccagttctctatcactattgtttcagcaatggcgctttcagtactggttgcgctgattctcacccccgcgttatgtgcaacattgctgaaaccagtctctgccgagcatcacgaaaataagggaggattcttcggctggtttaacaccactttcgatcatagcgttaatcactacaccaatagcgttggcaaaatcctcggttccacagggcgatatttactgatctatgcgctgattgttgcaggaatggtggtgttgtttttacgtcttccgtcttccttcttacctgaagaggatcagggtgtctttctgaccatgattcagttacccgctggcgcgacgcaagagcggacgcaaaaagtgttggatcaagtgacggattactatctgaagaacgagaaagcgaacgttgaaagtgtctttacagttaacggctttagcttcagcggccaggcacaaaacgccggtatggccttcgtcagtctgaaaccgtgggaagagcgtagtggtgacgaaaacagtgcggaagcagtaatccatcgtgccaaaatggaattgggcaagatccgcgacggttttgtcattccatttaatatgccagccattgttgaactgggcacggcaacgggtttcgactttgagttaattgatcaggctgggctgggtcacgatgccctgacccaggcccgtaaccagttgcttggcatggcggcgcaacatcctgccagcttagtcagcgtgcgccctaatggcctggaagacaccgcgcagtttaaactggaagttgaccaggaaaaggcgcaggcattaggtgtttcactttctgacatcaatcagaccatttcaacggcgttgggtgggacttacgttaacgacttcatcgaccgtggtcgcgtgaaaaaggtgtatgttcaggcggatgccaaattccgtatgctgccagaagatgtcgataaactttatgtccgcagcgccaacggcgaaatggtgccattctctgcctttaccacttcacattgggtgtatggctctccgcgactggaacgctacaacggtctgccgtcaatggagattcagggggaagccgcgccaggaaccagttccggcgatgctatggcgttgatggaaaaccttgcgtcaaaattaccggcgggcattggttatgactggacgggtatgtcatatcaggaacgtttatcgggaaaccaggctcccgctctggtagcaatttcctttgtggttgttttcctgtgccttgctgcactctatgaaagctggtcaattcctgtctcggttatgttggtcgtgccgttagggattgtcggcgtgctactggcggcaacactctttaatcaaaaaaatgacgtctactttatggtgggcttgctaacgacaattggcttgtcggccaaaaacgctattttgattgttgagttcgctaaagatctcatggagaaagagggtaaaggtgttgttgaagcgacactaatggcagtacgtatgcgtctgcgtcctatcctgatgacctctctcgcctttattctcggcgtattaccgctggctatcagtaacggggccggcagtggcgcgcaaaacgcagtcggtatcggggtaatgggcggaatggtctctgcaacgttgctggcaatcttcttcgtgccagtgttctttgtggtgatccgtcgatgctttaaaggataaatcagaaacataaaggcgctttcaggcgccttttttattgtgcacagaaaacccccagctaggctgggggttccggaaagctttcagctttgagccagttattaaaaccccttttgatttgttaaaacaccttgcggtctggcaactgcaagtgtcaaacaagaaatcaaaagggggtcccaatggggaacgaaaagagcttagcgcacacccgatggaactgtaaatatcacatagtatttgcgccaaaataccgaagacaggtgttctacagagagaagcgtagagcaataggctgtattttgagaaagctgtgtgagtggaaaagtgtacggattctggaagctgaatgctgtgcagatcatatccatatgcttgtggagatcccgcccaaaatgagcgtatcaggctttatgggatatctgaaagggaaaagcagtctgatgccttacgagcagtttggtgatttgaaattcaaatacaggaacagggagttctggtgcagagggtattacgtcgatacggtgggtaagaacacggcgaagatacaggattacataaagcaccagcttgaagaggataaaatgggagagcagttatcgattccctatccgggcagcccgtttacgggccgtaagtaacgaagttggatgcaaatgtcagatcgtgtgcgcctgttagggcgcggctggtaagagagccttataggcgcatttgaaaaacctccggctatgccggaggatatttatttttcagtgaaccccataaaaattaataagatattcttcttctcactctttaaaaactttctatagttcccgctcccttcactatttttacaattcacataaattgtcattattcattccgcaagatttataacctccagtgataaaatgtcattcagctcgttaataagagagttaacttattaagcgttagcgtttattactgaggtaacaccatgaaaagattaattcctgtgacattgctcaccgcattgctggcgggctgtgctcacgattcgccctgcgttccggtttatgacgatcagggtcgtctggttcacaccaatacctgtatgaaaggcacgactcaggataactgggaaacggctggggctattgccggcggggcagcagctgttgctggcctgacgatggggatcatcgctctgtcgaaataactaaacagggcgcggagctccgcgctctttttaacgatacagtatctttccataagataaaatattgctatattctgctgggtaattccctgctgatttagcatgttatatcacgttatttcgctgctttcgaaataacgcatcaatttaactttcacacatcccaccagaaatatactcacgctaacaatcattattctgcttagtaaaaaacgcgtaaatattttgcgccaaaatgtggcgcatgtttcattttcgcaccattgcggggcgctgtttttattatttcctgtctacactcagcttattgcgacgcgaaatcgtgcgcaaaagctggcactacttttgcttataagaggatggccacagacaggtaaaagacgtttcccaaacgtcctataacgataattttcgcctcacaggaagcattatgaaaaagatgatgatagccacactggctgccgccagcgtgctgcttgccgttgcaaatcaggcgcatgctggcgcgacgcttgatgccgttcagaaaaaaggttttgtgcaatgcgggatcagtgatggattacctgggttctcttatgccgatgctgacggtaagttttcaggtattgatgtagatgtttgtcgtggcgttgccgctgctgtattcggtgacgatacgaaagtgaaatataccccgctcactgcaaaagaacgcttcaccgctttacagtcaggggaggtggatttgctctcccgtaatacgacctggacttcatctcgcgatgccgggatgggaatggcatttactggcgtcacttattacgacggcattggcttcctgacacacgataaagcggggctaaaaagcgcgaaagaactggatggcgctaccgtctgtattcaggcggggactgataccgaactcaacgtcgccgattacttcaaggcaaataatatgaagtacacgccagtaaccttcgatcgctcagacgaatcagcgaaggctctggaatctggccgctgcgatactctggcctcggatcaatcacaactgtatgccctgcgcatcaaattaagcaacccaactgaatggattgtcttaccggaagttatctctaaagaaccacttgggccggtagttcgtcgtggcgatgatgaatggttctcgattgtacgctggacgcttttcgccatgctgaatgctgaagagatgggcatcaattcccagaacgtcgatgaaaaagcggctaatccagcaacgcctgatatggcacatctgctgggtaaagaaggcgattacggcaaggatctgaagctggataataaatgggcctttaacatcatcaaacaggtgggtaactactcggaaattttcgagcgtaacgtaggttcagaaagcccgctgaaaattaaacgtgggcaaaataatctctggaataatggcggtattcagtacgcgccgcccgtgcgttaagtcggtgtgaggtaacgagcgtcgctacggcggcgctctcttcagcgttatgctttccgaggtttctatgtctcatcgccgctcaaccgttaaaggctcactctcttttgccaaccctacggttcgcgcctggttattccagatccttgccgttgttgctgttgtcggcattattggttggttatttcacaacactgtaacgaatctcagtaatcgcggcataacatcaggatttgcttttcttgaccgcggggccggttttggcatcgttcagcatttgattgattatcagcaaggcgacacttacggacgcgtttttattgtcggcctgctcaatacgctactggtttctgcattgtgtattgtgttcgcttctgttttgggcttctttatcggtctggcgagactttcggataactggctgctacgaaagctttccacaatttatattgagatcttccgtaatattccgccattgctgcaaatcttcttctggtactttgccgtgttgcgcaatttgcccgggccacgccaggcagtgagcgcactggatttggtgtttctgagcaatcgtgggctttatattccgtcgccgcagctgggagatgggtttcttgcgtttatcctggctgttgttatagctatagtcctttctgttgggctattccgctttaataaaacacaccagataaagaccggacaactgcgccgcacctggccgattaccgcagtgttgatcattggtttgcctttactggcgcaatggctttttggcgcagcactacactgggatgtcccagcccttcgaggctttaatttccgcggcgggatggttttaattcctgaactggcagccttaacgctagcactttcgatttatacctctgcatttatcgccgagattatccgagcagggatccaggcagtgccttatggtcaacatgaagcggctcgatcactgggattacccaacccggtaacgctacgccgggtcattattccccaggcattgcgggtgattattccaccgttaaccagccagtatctcaacatcgtcaagaactcctctcttgccgccgctattggctatcccgatatggtttcgctgtttgctggcaccgtgctgaaccaaacggggcaagccatcgagacgatagccatgaccatgtcggtctatctgattatcagcctgactatctcgctgctgatgaatatctataaccgccgcatcgcgatcgttgaacgctaaggagtcatgatgacaaaagtattgctgtctcatcccccgcgcccggcgagccataactcaagccgcgcgatggtgtgggtgcgaaaaaatctgttctccagctggagcaatagcctgctgactattggctgcatatggttgatgtgggaactgatcccaccattgctgaactgggcatttttgcaggctaactgggttggctcaacgcgtgccgactgcacaaaagccggtgcctgttgggtcttcatccacgaacgatttggtcagtttatatatggactttacccacacgaccaacgctggcgaattaacctggcattactgattggccttgtgtctatcgcaccaatgttctggaaaatacttccgcatcgcggtcgctatattgcggtctgggcggtgatttacccactggttgtctggtggctgatgtatggcgggtttcttggtcttgatcgggttgaaacccggcaatggggcgggttgacgctaactttaattattgcatcagttgggattgcgggggcgctaccgtgggggatcttactggcgttaggtcgccgctcccatatgccgattgtgcgtatcttatcggtcatttttatcgagttctggcgcggcgtaccgctgattaccgtattgtttatgtcttcggtcatgctgccgttgtttatggcagaaggcaccagtatcgacaaactaatccgcgcgctggttggcgtgatcctgtttcagtcagcatatgttgcggaagtcgtgcgaggcggattacaggcgctgcctaaagggcaatatgaagcggcagagtcgctggcattgggttactggaaaactcaggggcttgttattctgccacaggcgttgaagctggtaattcctgggctggtaaataccatcatcgcactcttcaaagataccagcctggtgatcatcatcgggttgttcgatcttttcagtagcgttcagcaggcaaccgttgatcccgcctggttgggtatgtcgacggaagggtatgttttcgccgcgctgatctactggatcttctgtttcagcatgtcacgttatagccaacatctggaaaaatgttttaacaccgggcgtacaccgcattgaggacactatgagccaaattttactgcaacctgctaacgcgatgattacgctggaaaacgtcaataaatggtatggacaattccatgttttgaaaaatataaatttaaccgtgcaaccgggcgaacagatcgttctatgtggcccttcaggttccggtaaatcgacaaccattcgttgtattaatcatctggaagaacatcaacagggacggatcgtggtagatggcatcgaacttaatgaagatatccgcaatattgagcgcgtcaggcaggaagtgggaatggtctttcagcatttcaatctcttccctcatctgaccgtgttacagaactgtaccctggcaccgatttgggtacgcaagatgccaaagaaagaggctgaagctctggcgatgcattaccttgagcgggtgagaattgccgaacatgcccagaagtttcccggacagatttctggtggtcagcagcaacgtgttgccatagcacgttcgctgtgtatgaagccgaaaattatgttgtttgatgagccaacgtcggcgctcgatcctgagatggtgaaagaggtgctggatacgatgattgggctggcgcagtcgggtatgacaatgttgtgtgtaacacatgagatggggtttgcacgaaccgtcgctgaccgggtgatttttatggatcgtggggaaatagtggagcaagctgcacctgatgaattttttgcgcatcctaaatcagagcgtacgagggcatttttatcgcaggtaatccattaattgaatgttagttcgaaaagcaaaaaggccatcctttcggatggcctttcgcttgatttgatgtctggcagttccctactctcgcatggggagaccccacactaccatcggcgctacggcgtttcacttctgagttcggcatggggtcaggtgggaccaccgcgcaactgccgccagacaaattcttttctaatctgccgaactttaacctaaaaagtggtgctgatacccagagtcgaactggggacctcacccttaccaagggtgcgctctaccaactgagccatatcagcacgctaaatttgatgcctggcagttccctactctcgcatggggagaccccacactaccatcggcgctacggcgtttcacttctgagttcggcatggggtcaggtgggaccaccgcgctaaggccgccaggcaaattctgtttatcagaccgcttctgcgttctgatttaatctgtatcaggctgaaaatctttctctcatccgccaaaacatcttcggcgttgtaaggttaagcctcacggttcattagtaccggttagctcaacgcatcgctgcgcttacacacccggcctatcaacgtcgtcgtcttcaacgttccttcaggagactctaagtctcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggattacgggccaacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttcgcgttgccgctaaccccatcaattaaccttccggcaccgggcaggcgtcacaccgtatacgtccactttcgtgtttgcacagtgctgtgtttttaataaacagttgcagccagctggtatcttcgactgatttcagctccacgagcaagtcgcttcacctacatatcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgtcgcttcagcaccgtagtgcctcgtcatcacgcctcagccttggttttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcaaccctcacaggccaccttcacaggcttacagaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagtcgggatgacccccttgccgaaacagtgctctacccccggagatgaattcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttcccttcggctcccctattcggttaaccttgctacagaatataagtcgctgacccattatacaaaaggtacgcagtcaccccattaagaggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagtatgtgcatttttgtgtacggggctgtcaccctgtatcgcgcgcctttccagacgcttccactaacacacacactgattcaggctctgggctcctccccgttcgctcgccgctactgggggaatctcggttgatttcttttcctcggggtacttagatgtttcagttcccccggttcgcctcattaacctatggattcagttaatgatagtgtgtcgaaacacactgggtttccccattcggaaatcgccggttataacggttcatatcacctcaccgacgcttatcgcagattagcacgtccttcatcgcctctgactgccagggcatccaccgtgtacgcttagtcgcttaacctcacaacccgaagatgtttcttgcgattcatcatcgtgttgcgaaaatttgagagactcacgaacaactttcattgttcagtgtttcaattttcagcttgatccagatttttaaagagcaaaacttcgcagtgaacctttgcaggtacactctgaagtattttttatttaatcactacagagatggtggagctatgcgggatcgaaccgcagacctcctgcgtgcaaagcaggcgctctcccagctgagctatagccccataacatgtagttaaaacctcttcaaatttgcggtgcaaatttggtaggcctgagtggacttgaaccaccgacctcacccttatcaggggtgcgctctaaccacctgagctacaagcctgtagaggttttactgctcattttcatcagacaatctgtgtgagcacttcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacggttcccgaaggcacattctcatctctgaaaacttccgtggatgtcaagaccaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccacgcctcaagggcacaacctccaagtcgacatcgtttacggcgtggactaccagggtatctaatcctgtttgctccccacgctttcgcacctgagcgtcagtcttcgtccagggggccgccttcgccaccggtattcctccagatctctacgcatttcaccgctacacctggaattctacccccctctacgagactcaagcttgccagtatcagatgcagttcccaggttgagcccggggatttcacatctgacttaacaaaccgcctgcgtgcgctttacgcccagtaattccgattaacgcttgcaccctccgtattaccgcggctgctggcacggagttagccggtgcttcttctgcgggtaacgtcaatgagcaaaggtattaactttactcccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgagcctttaccccacctactagctaatcccatctgggcacatccgatggcaagaggcccgaaggtccccctctttggtcttgcgacgttatgcggtattagctaccgtttccagtagttatccccctccatcgggcagtttcccagacattactcacccgtccgccactcgtcagcaaagcagcaagctgctttctgttaccgttcgacttgcatgtgttaggcctgccgccagcgttcaatctgagccatgatcaaactcttcaatttaaaagtttgatgctcaaagaattaaacttcgtaatgaattacgtgttcactcctgagacttggtattcatttttcgtcttgcgacgtcaagaatccgtatcttcgagtgcccacacagattgtctgataaattgttaaagagcagttgcgacgcggctttcagctcactgtcgcgaggtggcgtatattacgctttcctctttcagagtcaaccctgaacttcaggattttttctctttgttgttacgaccatcttgtgaagtgtttcacgttgtcgtctcaacggaggcgcattatagggatcccaattttttgcacaagtacttttttgatctttttttctgtttgttgctttttcaccctttttgctgcattcgcacacaaaacggtgcttttttgcatgctaaaagacttgcacaaggccaataatgcacccaaagtcattagtaaatcatttattgttgaggtgagtatgtctgatgttttacgcccataccgcgatctttttccacaaatcggtcagcgcgtaatgatcgacgatagcagcgtcgtgattggtgacgttcgtctggctgatgatgtggggatctggccgctcgttgtgattcgtggagatgtacattatgtacagatcggagcacgcaccaatatccaggatggcagtatgttgcatgtcactcataaatcctcgtacaacccagatggcaacccattaaccattggcgaagatgtcactgttggtcacaaggtgatgctccacggctgcaccattggcaatcgagttttggttgggatgggctcaattttacttgatggcgcaatagtagaagatgatgtgatgattggtgcgggtagcctggtcccacaaaataaacggctggagagcggatatctgtatctcggtagccccgtcaaacagatccgcccgttaagtgatgaagagaaggctgggttacgctattccgcaaataactacgtgaaatggaaggacgaatatctggatcaaggtaaccagacccaaccttgatcatcttcactttgttcctgaattaagttttccgcttcttcttccaggtcccagcgatgctgacgaaaactcgctaaccactgttctggcgtatctccagtaaagcgatacgccagactctcgccagagatcgcacatgtcagttgcataccattcacgagagcgggaaaacatacacatcttttattctcgtcccactcttccctatccggaaactggatggcctgattcacgctgacaattcctgttgcaatagtttgatgaccggttctacatcaggcagaacgccatgccaaagaaggaaggcatgagccgcctgtgccaccagcattcctaaaccatcagcattacgctttgagcctcgctgctcacaccatgccagaaaaggagtttttcctttctgatagaacatgtcatagcaataaatgcctggatgaatgagcgatgacgggatcgccggaatatcaccactgatgccactggatgttgcattaataatgagatcaaactcatgaccttccagttcgtccatacccaacgcctgaatactgccagtgtgcgcaaacaatttagtcaactcttctgcgcgagataccgtccgattagtgattgtcaccgcacggtccagggaaaggagtggcagtagtacgccgcgagatgctccaccagcgccaatgagcagaatacgtaaaccaggacggataaaagacagacgttccagatcgcttaacaaacctataccatcggtattgtcacccagcaggcgtccatcttctaaccgcttgagggtattaacagcaccagccaacgctgcccgttcagtaagctcatccgctctggcaaaagcctcttctttaaaaggtaccgtcacattcgcacctttaccaccagcactaaagaaagtgttcagtgtgttgatgaaatcattgatgggtgccaacacacgcccatagggatgttcaatattcagttgctgagcaaattgctgatgaatgaatggcgatttgctgtgggctatcggattaccaaaaacagcataggtttccattatgttacccctgtcgaaacagttcacccgtcagggcatcgcggatttctgaaggatttaaacgcccccccgtttcaccaggcacaaccgggaacgcagcgccaaattgtgcgcgaacttcgtctactgttcgacaaggtggcaatccactcaagttggcactggtagaaaccagcggtttaccataagcctggcacaaagcaaccaccaacggatggtcggtgactcgtacagcaagcgaatcaaagcggcccgtcaaccagcgcggtgttgtcgcaggcgcgggaaagacaaaggtgacaggacctggccagcgggaaaaaatggtttcacgctgcgcgtcagtcagcatggtgtcatcaatatagggtttaagctgctcgtaatttgccgcgattaaaatcagccccttatcaaccggacgccgttttaactccaacagtctcatcactgctgtttcgctatcaggatcgcacccgacaccgaaaacggcttccgttggataggcgatgacacgttcttcattgaggacatctatcgcagctgcgatagcgtctccttgcaggttattattcacgttattattccgccgaaatcggctttccacattgtttactggcacaaaagtgttttacaccctgcgcggttttcttttcgatgagtagcggataatggcactcagggcattctccagctatgggtttgaagttaatggcaaattgacactccgggtagcgatcacaggagtgaaatgttttgccataacgggagcggcgctgaaccagatggcccgtccggcattgggggcatgtaattgctgtttcgtccggtttatcgataagttcggtatgttcgcattcagggtagttactgcaaccaataaacataccaaagcgtccctggcgtaataccagatttgcgccacatgcagggcaaacctgcccctccagaactttgacaatatgtccatccgctgaagatttcagaggacggacgtagtcacacgccggatactgtgagcatccaagaaacggaccgtgtttcccggatcgaataactagttcagccccgcactttgggcaggactcattattacgcaccgtgaacagtgctgatttcgccataactacttatgctgaattaaagaaatgattaatgcagcataccttcattcacttcaaagagtaattcttccatttgctggtacgcattttcgcagcccggaatattgaacaacaccatcaggattacccatttcaggtcttccaggtcgaactcagcggtatccagcgcgagcactcgctctatcaccatttcacgggtttcaaggttaagcacctgaatttgctcaaggaaaagcagaaaaccacgacagctggcatccagtctttcacactcttcaggggtataaatacgcatggagagtggatcagaggccagttgcatcggttctgccagtccttcctgataatccgcaagcttttccagccaaagcagggcattgtagatatcttctcgatcaaatcctgcgtcggtaagatcctgttcaagtttgtcttgatccacacgcaactcagcttctgtgtgaatataggtttcaaacaaatacattagtacgtcgaacatggcatgccctcctcaatcggacatagccgccgggtacagctgcgatccatcctgctaactccagttcgagtagttgagtaactacctctggcacaggttggccggcacgttcagcgacgacgtcaacaggtgttacctcatctcctacgttagccaggagctcaggaaatggcaatgccacgtcttcctgatctggtgaataaaatgaattttcaggggcgtctggcaaccagtgcaatccaaattgcaagttttccagaatttcttccggttccgtcacaagaatcgcaccttgttttattaaccagtgaggcccttcgcttcccggattccctattggacctggcaaagcaaaaacttcacgcccctgctcaagcgcacaacgtgctgtcaccagcgaaccactgcgcaaagccgcttccaccaccagtacacctttacttagaccactgataatgcgatttcttcgtgggaaattgtaagcaaggggtggaacatcgaggggaaattccgagacgagagcaccaccttgctcaagtagactggcagccagtggagcatggcggcggggatgaatggtattaagtccattccccaatacagcaatgctaacgccatttacctgtaaggccgctttatgcgccacaccatcgattccacgcgccagtccactcgtaattgtcactccacgcgtcgccagagtttcgcaaaataatcgtccccatcgctcgccataccatgaatgcgcccgactccccactacggcaagctgaaatgaatgcaacgcgtgcagttctccttcaacaaacagtgcgccggggtaatctgtcgtcgccagaagttgaggaggataaaattcgctgtccgcagggattaaatgatggttgggttgctccaaccaacaaagtgagctttcgatactctttcgcggaaatgaaagaaagcgttgtgcctgccgcaatgtaagccctgtttgctgcaatacaaccgcatcaatatgcgactgttttgccagccagtgagctatacggaccatatcatcgccatacaagctgctgatgctaattaaacgcagccaaatttctgtatcgaccatccttatctccctgccataagcagccttagcaatctttgcgattggtcagtgatgctgtcaatcagagggggatttgtctagaatagaagaaataatctttctaactcctgaacacatctctggagatttatgtcagttttgcaagtgttacatattccggacgagcggcttcgcaaagttgctaaaccggtagaagaagtgaatgcagaaattcagcgtatcgtcgatgatatgttcgagacgatgtacgcagaagaaggtattggcctggcggcaacccaggttgatatccatcaacgtatcattgtaattgatgtttcggaaaaccgtgacgaacggctggtgttaatcaatccggagcttttagaaaaaagcggcgaaacaggcattgaagaaggttgcctgtcgatccctgaacaacgtgctttagtgccacgcgcagagaaagttaaaattcgcgccctggaccgcgacggtaaaccatttgaactggaagcagacggtctgttagccatctgtattcagcatgagatggatcacctggtcggcaaactgtttatggattatctgtcaccgctgaaacaacaacgtattcgtcagaaagttgaaaaactggatcgtctgaaagcccgggcttaaggataagaattaacgtgtcagaatcactacgtattatttttgcgggtacacctgactttgcagcgcgtcatctcgacgcgctgttgtcttctggtcataacatcgttggcgtgtttacccagccagaccgaccggcaggacgcggtaaaaaactgatgcccagcccggttaaagttctggctgaggacaaaggtctgcccgtttttcaacctgtttccctgcgtccacaagaaaaccagcaactggtcgccgatctgcaggctgatgttatggtcgtcgtcgcctatggtttaattctgcctaaagctgtgctggagatgccgcgtcttggctgtatcaacgttcatggttcactgctgccacgctggcgcggtgctgcaccaatccaacgctcactatgggcgggtgatgcagaaactggtgtgaccattatgcaaatggatgttggtttagacaccggtgacatgctttataagctctcctgcccgattactgcagaagataccagtggtacgctgtacgacaaactggcagagcttggcccacaagggcttattactacgttgaaacaactggcagacggcacggcgaaaccagaagttcaggacgaaactcttgtcacttacgccgaaaagttgagtaaagaagaagcgcgtattgactggtcactttcggcagcacagcttgaacgttgcattcgcgctttcaatccatggccaatgagctggctggaaattgaagggcagccggttaaagtctggaaagcatctgtcatcgatacgacaacaaaggctgcgccaggaacaatccttgaagccaataaacaaggcattcaggtagcgacaggtgatggcatcctgaatctgctctcaatgcaacctgcaggtaagaaagcgatgagcgtgcaagacctcctgaattctcgtcgggaatggtttgtaccgggcaaccgtctggcctgatagtccactcttctaagcccggtcttaccgggcatctttatatttatacttatgaaaaaacaacgtaatttacgtagcatggcggcccaggccattgaacaagtcgttgagcaagggcaatcactgagcaacattctgccaccgctccagcaaaaagtttccgataaagataaagctcttctccaggagttatgctttggcgtactgcgtacgctctcacagttagagtggctgattaataagctaatggcccgtccgatgacaggcaaacagcgtactgttcattacctgattatggttggtttgtatcaactgctttatacccgcattccacctcatgccgcgctggctgaaacggttgaaggcgcagttgcaattaagcgcccgcaacttaagggattgattaacggtgtattacgtcagttccagcgtcagcaagatgagttattagccgagtttaatgccagtgatgcacgttatctgcatccttcctggttgctgaagcgtctgcaaaaggcgtatcccgagcagtggcaatccatcgtcgaagccaataaccagcgtccgccaatgtggctgcgcgttaatcgtacgcatcattcccgcgacagctggcttgcattgctggatgaagcaggaatgaaaggtttcccgcatgcggattaccctgatgctgtacagctggaaacacctgcacctgttcatgcgctacccggttttgaagaaggatgggttaccgttcaggatgcttcagcacaaggttgcatgacctggcttgctccacaaaatggtgaacacattctggatctttgcgccgccccaggcggtaaaacaacgcatattcttgaggttgctccagaggcgcaagttctggcggtcgatattgatgagcagcgcctctctcgcgtttacgacaatttaaaacgccttggtatgaaggcaaccgtaaaacaaggtgatggccgttacccttcccaatggtgtggtgagcaacagttcgatcgcattttattagatgcaccttgttcggcaactggtgtaattcgtcgccatccggatattaaatggttacgccgcgatcgcgatatcccagaactcgcgcagttgcagtctgaaattctcgacgccatctggtcgcatttaaaatccggaggaaccctggtctatgccacctgttcggtgttaccggaagagaatagcctgcagattaaagcctttttgcaacgtaccgctgatgccgaactttgcgaaacaggaacaccagagcaaccgggtaaacaaaatttgcccggtgccgaagagggcgacggcttcttttacgctaagctaatcaaaaagtgatgagataacgggtcgcgactgatgaaaattatcattctgggtgccggccaggttggcggcacactggcggaaaacctggttggcgagaacaacgatattactgttgtcgataccaacggtgagcgtctgcggaccttacaggataaatttgacctgcgagtcgtgcaggggcatggctctcatccacgcgtattgcgggaggcaggtgccgacgacgccgatatgctggttgctgtaaccagttcagatgaaaccaatatggttgcctgccaggtagcctactcacttttcaacacccctaatcgcatcgctcgtatccgctcaccagactacgtgcgcgatgccgataagctatttcattcagatgctgttccgattgatcatctgatcgcaccagagcagttggttatcgataatatttaccgactgattgagtatcccggcgcattgcaggtggtgaacttcgctgagggtaaagtcagcctggctgtggttaaagcctattatggcggcccgctgattggtaatgcactttcgaccatgcgcgaacatatgccacatatcgatactcgtgtggcagcaattttccgccacgatcgccccattcgtccgcaaggttcgaccattgttgaagctggtgatgaagtgttctttattgccgcttcacagcatatccgcgcggtgatgagtgaattacagcgactggaaaaaccgtataagcggatcatgctggttggtggcggtaatatcggtgcagggctggcgcgtcgtctggaaaaagattacagcgttaaactcatcgaacgtaatcagcagcgcgctgccgaactggcggaaaagttgcagaatacgatcgtcttttttggtgatgcgtcggatcaagaactgctggccgaagaacatatcgatcaagttgatctgtttattgccgtcaccaacgatgacgaggccaatatcatgtccgccatgcttgccaaacgtatgggtgcgaaaaaggtgatggtattgatccaacgtcgcgcttatgtggatctggttcaggggagcgtgatcgatattgcgatttcaccacaacaagcaactatttctgcgttgcttagccatgtgcgaaaagcagatattgttggtgtttcctcattacgccgcggcgtagcagaagctattgaagccgttgctcacggtgatgaaagcacctcacgcgttgtcggcagagtcattgacgaaatcaagctaccgccaggaacgattattggagcggtggtacgtggaaacgatgtgatgattgccaatgacaatctgcgcattgagcaaggcgatcacgtaattatgttcctcacagataaaaagtttattaccgacgtcgaaagactcttccagccaagtcctttcttcttgtaattaataaggcgtctaatgacgccttattatttccctttgattattaaggattaattaaatccattcctggcaggaaaatggcttaacatttgttagacttatggttgtcggcttcatagggagaataacatgagcattattaaagaatttcgcgaatttgcgatgcgcgggaacgtggtggatttggcagtgggtgtcattatcggagcggcattcgggaagattgtatcttcactggttgccgatatcatcatgccacctctgggcttattaattggcgggatcgactttaaacagtttgctgtcacgctacgcgaggcccaaggggatatccctgctgttgtgatgcattacggtgtcttcattcaaaacgtctttgattttctgatagtggcctttgccatctttatggcgattaagctaatcaacaaactgaatcggaaaaaagaagaaccagcagcagcaacacctgcaccaactaaagaagaagtattactgacagaaattcgtgatttgctgaaagagcagaataaccgctcttaacaagcgtctgaaagcagaaggccagtggtaaaaaagtgatttactttcttgccactggcctcccagttcccccgattgccatgttttccttttcgcatgtaactgcctttccctttcttatttttctctactcgctgtcggaataagggatcatgtagtaatgcttctatcgcattatcctttatctgccctttagtatgctgatatcggctcataaaaactccagttggttatttaacggcgcgagtgtaatcctgccagtgcaaaaaatcaacagccactcttaacgccactcgccccttgttcaagagcttcaagaatcgagcaataaacactgctatgggcggtcccacaacaggtatcattaaggcgttgcaaggaacgctgcatactctgcaactcggctatacgagcttcgacttcctgcaatcgttcctgcacaatgccttttgactcctgacaggtatggtgttccggatcgatacggatcgacagcaactcgcggatcgactccagactgaaacctagttgtctggcatggcggataaatttcaatcgctggagatcgcttttggtatacaggcgaaacccaccttcggtgcgtacttcatgctccatcatctgctgcttttcgtaataacgaatcgtgtcgggtgttacttccgccatttttgccagctcaccaatgcgatacatacatactccactagttatcgttgattttgttcaacaacttgtcagcataatcgccgcgtaaaaaatcggtactcaatccagcttgtcgcagcttcaattccagtaatgacaatcgacgactaacctcttgatattgcggatcatcatgacggatacctttgagaatatccagaagctgtattgcttccctcctattctcaagttctggcggtaagcaaccagcattcttcagcaagcgataccccgcacgtaattccggtggcacatgagaatcatcatccagtatcaatggttcgccgctacctaccaggttatcaaactcacctttcgcttgcgcttctgctatatgacgctctgcccactggtcaagtaaccacataaatactccaggggatgaacaaaaagagtacagctattgtagataagtggggatgctacgggtataaaaaaacccgccggggcgggttttttacgttgcttcagattactctgcagcagcttctgttttctctgaacgatcaaccagctcgatgtaagccatcggcgcattgtcgcctgcacggaagccacacttcagaatacgagtgtaaccaccggcacggctcgcgaaacgcgggcccagttcgttaaacagttttgccacgatctcgttatcacgagtacgggcgaatgccagacgacgattagcaacgctatcagtcttggcaagagtaatcagcggctcaactacgcggcgcagctctttcgctttaggcagagtcgtcttgatgatttcatgacgaaccagtgaacctgccatattgcggaacatagcctggcgatggctgctgttgcggttcagttgacgaccactcttacgatggcgcatgaccttatccttctcagtaaaaccttaacctgtgatccggttactcgtcagcgatgcttgccggtggccagttttccaggcgcatgcccagagacagtccacgggaagccagcacgtctttaatctcagtaagagattttttaccaaggttaggcgttttaaggagctcaacctcggtacgctgtaccagatcaccgatatagtggatagcttctgctttaaggcagttagcagagcggacagtcaattccagatcgtcaacagggcgcagcaggatcggatcgaactctggtttctcttctttcacttcaggctgacgtacatcacgtaagtcaacgaaagcttccagttgttcagccagaatggttgccgcacgacgaatcgcctcttcaggatcgattgtgccgttggtttccatttcgatgaccagcttgtccaagtcggtacgctgttctacacgcgctgcttcaacattgtaggcaatacgctccacagggctgtagcatgcgtcgaccagcagacggccgattgggcgctcatcttcttccgaatgaattcgggtagaagccggcacataaccacgaccgcgctgaactttgatacgcatgctaatagacgcgttctcatcggtcaggtggcagatcacgtgctgcggcttgacgatttcgacatcaccgtcgtgggtgatatcggctgcagtcacagggccaatgccagatttattcaaggtaagaataacttcatctttgccctgaactctcaccgccagccctttcaggttgagcaggatttccaggatatcttcctgaacgccttctttggtgctgtactcatgtagtacaccatcaatctcaacctcggtcaccgcgcaacccggcatcgatgagagcagaatacggcgcagtgcgttacccagagtatggccaaagccacgctctaaaggctcaagggtcaccttggcgtgcgtcgaactcacttgctcgatatcaaccaggcgcggttttagaaactctgtcacagaaccctgcattgtgtcctctctttggtactaagctttacttggagtaaagctcgacgatcaggtgttcgttaatgtccgcagacagatcagaacgctccggcttacgcttaaacgtaccttccatcttgccagcatcaacttccagccaggttggcttttcacgctgctcagccagctccagagcggctttcacgcgagactgcttcttcgctttctcacgaatgcttacaacgtcattcggactaacctgataagaagcgatgttaacaacacgaccgtttaccataattgctttatggctaaccagctgacgtgcttctgcacgagtggcaccgaagcccatacggtatacaacgttgtccagacgaccttccagcagagccaacaggttttcaccggtgttgcctttcagacgtgctgcttctttgtagtagttacggaactgacgctccagcacaccatagatacggcgaactttttgcttttcacgcaactgcacaccatagtcagacagacgcggtttacgcgcaccgtgctggccaggagcttgttcaattttacacttggtatcgatcgcgcgaacgccagacttaaggaataagtcggtgccctcacgacggctcagcttgagcttaggacccaaatatcttgccattttctttctccaacaaacctggaaaacgaggcgttatacgcgacgttttttcggcggacgacaaccgttatgagggatcggagtcacatcagtaatgttagtgatgcggaaacctgcggcgttcagagcacgaatagtagattcgcggcctggacccggacctttaaccataacttccagattcttgatgccgtattctttcacggcgtcagcgcaacgctctgctgcaacctgtgctgcaaacggagtggatttgcgagaaccacggaaaccggaaccaccggctgttgcccaacccaacgcgttaccctgacgatcagtgatagtcacgatggtgttgttgaaagaagcatggatatgagccacgccgtcagagacttgttttcttacacgtttacgtgcacgaattggtgcctttgccattattcaatcaccccgattatttcttgatcggtttgcgcggacccttacgggtacgtgcgttggtcttggtacgctgaccgcgaaccgggagaccacgacgatgacgcaaaccgcgatagcaaccaagatccatcaggcgcttgatgctcatgctgatttcacggcgcagatcaccttcaacgacaaatttggcaacttcgtcacgcagcgtgtcgatttgtccttcagacagctcactgatcttaacatcttcagcgatacccgctgcagccaggatggctttagaacgggtcttgccgacgccataaatcgaagttaatgcgattacggcatgcttatgatcaggaatgttaatgcctgctatacgggccactatgcactcctactatttaatatgtacgttccatgctgaaaagcccgttttcaggatactcaaatggaaacgcacagacatacaaaagattggctggctaatctagccagctcaacccaactttgcaagaaaaatatgcgaaaaaatcagccttggcgctgtttatgcttcggctcggcactgcaaatcacacggatgacaccatcacgcttaacgattttgcagttacggcataatttcttgacggaagcacgaactttcatttttactctccgtaacttctcgggcgaccaattatcggccgtagcctttcaggttcgccttcttcaatgcagactcatactgactggacatcatcagagtttgcacttgagccataaagtccataatcacgacaacaacgataagcagtgaggtcccaccgaagtagaacggtactttcattgcatcacgcatgaactccgggatcaggcagataaaggtaatgtacagcgcaccaaccaaggtcaggcgggtcattactttatcgatatacttcgccgtttgctctcccggacgaattcctggtacaaatgcaccggacttcttcaggttatctgctgtttcacgcgggttgaaaaccaacgccgtgtagaagaaacagaagaagatgattgcagacgcatagagtaacacataaagcggttgcccaggctgcaaatacagcgaaattgttgtcagccagttccaaccagtaccgcccccgaaccatgacgcgatggtcgccgggaacagaataatactggaagcgaagattgccgggattacccccgccatattcactttcagcggtaaatgtgtgctctgtgcagcatagacacgacgaccttgctgacgtttcgcgtagtttaccacaatgcggcgttgaccacgctcaacaaatacaacaaagaacgtcactgcaaatactaatactgcaaccaacagcaacacgaggaagtgcaggtcgccttgacgcgcttgctcgatagtatgggcaatggctggcgggagtcccgcgacaataccggcgaagataatgattgaaataccgttgccgatacctcgttcagtgatctgttcgcccaaccacatcaggaacatggttcctgtgaccagacttacaacagcggtgaagtagaatgcaaagcccgggttaatcaccaggccttgcataccaggcatattcggcagaccagtagcaataccgatcgactggaatattgccagcaccagagtaccgtagcgggtgtactggctgatcttacgacgaccagactccccttctttcttaatttctgccaacgttggatgaaccaccgtcagtagctggataatgatcgacgccgaaatatacggcatgatccccagagcaaagatagaagcacggctgagagcaccaccagagaacatgttaaacatctcaatgatggtgcctcgctgttgctcaagcagtttggcaagtacagcggcatcaataccagggatcggaataaaagagccaatacggaacacaatcagcgcaccgataacaaacagcagtctgcgtttcagctcgcctaagccacctttggcactttgaaaatctaatcccggttgtttagccatctgctacttattcctcgattttaccgccagcagcttcgatagcagcacgagcgcctttagtaacacgcaggccacgaacagttaccggagtcgttacttcgccagccaggatcactttcgcgaactcgatctggataccgataatgttagccgctttcagcgtgttcaggtctacaacaccgccttctactttagccaggtcagacagacgaacttcggctgtaatcgctgctttacgagaagtgaagccgaatttcggcagacgacggtacagaggcatctgaccaccctcgaaaccgcgacgtacgccaccgccagaacgagatttctgacctttgtgaccacgaccaccggttttaccgaggccagaaccgataccacgacccaggcgtttacccgcctttttggagccttcggccggagacagagtatttaaacgcatctcttactcctcaactttaaccatgaaggaaaccgcgttgatcataccgcgaatagcaggagtatcctcgcgctctacggtgtgaccaatacgacgcagacccaggccaagcagcgttgccttgtgtttcggcagacgaccgattgcactgcgggtttgagtaattttaatagtctttgccatggtttatttccccagaatttcttcaacggatttaccacgcttggcagcgaccatttctggagaattcatattttccaggccatcgatagttgcacgaaccacgttaatcgggttggtggaaccatacgctttagccagaacgttatgaaccccagcgacttccagaacggcacgcattgcaccaccggcgatgataccggtaccttcggaagccggctgcatgaatacgcgagaacccgtgtgaacacctttaacagggtgttgcagagtgccgttattcagcgcgacgttaatcatattgcgacgggctttttccatcgctttctggatcgctgctggaacttcacgcgctttaccgtaaccaaaaccaacgcgaccgttaccatcgccaactacagtcagagctgtgaaggagaaaatacgaccacctttaacggttttagatacgcggtttaccgcgatcagcttttcctgcagttcgccagcttgtttttcgatgtgagccatcttacacctctaccttagaactgaaggccagcttcacgggcagcatctgccagtgcctggacacgaccatgatattggaacccggaacggtcaaaggatacatctttgatgcctttttccagagcgcgttcagcgacagctttacccacagctgcagccgcgtctttgttaccggtgtacttcagttgttcagcgatagctttttctacagtagaagcagctaccagaacttcagaaccgttcggtgcaattacctgtgcgtaaatgtgacgcggggtacgatgtaccaccaggcgagttgcgcccagctcctggagcttgcggcgtgcgcgggtcgcacgacggatacgagcagatttcttatccatagtgttaccttacttcttcttagcctctttggtacgcacgacttcgtcggcgtaacgaacacccttgcctttgtaaggctcaggacgacggtaggcgcgcagatccgctgcaacctggccgatcacctgcttatcagcgcctttcagcacgatttcagtctgagtcggacattcagcagtgatacccgcaggcagctgatggtcaacaggatgagagaaacccagagacaggttaatcacattgcctttaaccgctgcacggtaacctacaccaaccagctgcagcttcttagtgaagccttcggtaacaccgataaccattgagttcagcagggcacgcgcggtaccagcctgtgcccaaccgtctgcgtaaccatcacgcggaccgaaggtcagggtattatctgcatgtttaacttcaacagcatcgttgagagtacgagtcagctcgccgtttttacctttgatcgtaataacctgaccgttgatttttacgtcaacgccggcaggaacaacgaccggtgctttagcaacacgagacattttttcctccgattaggctacgtagcagataatttcgccaccaagaccagcctggcgcgctgcacgatcagtcataacacctttagaggtagaaacaactgcgatacccagacccgccataactttcggcagctcatctttacgtttatagatgcgcagacctgggcggctgacacgctgaatgctttctacaacagctttgccctggaaatacttcagagtaagttccagttcaggcttggtgtcgccttcaactttaaaatcttcaataaaaccttcttccttcagcacgttggcgattgccactttcagcttggaggaaggcatggtgaccgcagctttgttcgcggcctgaccgttacggatacgggtcagcatatccgcgatcggatcttgcatgctcatctgtctttactcccgtgattcaattggtgacaattaccagctagcctttttcagacccgggatttcaccgcgcatagcggcttcacggaccttaatacggctcaacccgaacttccgcaggaaaccatgcggacgacctgtttgacggcagcggttacgctgacgagacgggctggaatcacgcggcagagtctgcagcttgagaacagcgttccaacgatcttcgtcggaagcgttcacatcagagatgatcgctttcagttcagcgcgtttcgcgaagtatttatcagctaaagctacgcgttttacttcgcgtgctttcattgattgcttagccatttagtaaccctaccttacttgcggaacgggaagtcaaaggcagccagcagagcgcggccttcttcgtcagatttcgcagtagtggtaatggtaatatccaaaccacgaacgcggtcgactttatcgtagtcgatttctgggaagatgatctgctcacggacacccatgctgtagttaccacgaccgtcgaaagacttagcggacaggccacggaagtcacggatacgaggtacagcaatagtgatcaggcgctcaaagaactcccacatgcgttcgccacgcagagttactttacagccgatcggatagccctgacggattttgaagcctgcaacagatttgcgtgctttggtgatcagcggtttttgaccggagattgctgccaggtctgctgctgcgttatccagcagttttttgtcagcgatcgcttcaccaacacccatgttcagggtgatcttctcgacccgagggacttgcatgacagaattgtagttaaactcagtcatgagttttttaactacttcgtctttgtagtaatcatgcagtttcgccatcgtactactccaaattacttgatagtttcgctgttagacttgaagaaacggacttttttaccgtcttcgaatctaaagcctacacggtcagccttgccggttgtcgcattgaagattgctacgttagaaacctgaatagcggcttctttttcaacgatgccacccggttggttcagggccggaaccggcttctgatgtttcttaaccaggttgataccttcaacaatgaccttgccggaagacaggacattcttaactttaccgcgtttacctttatctttaccggttaacacgataacttcgtcatcacgacggattttcgctgccatgattcgctccttagagtacttctggtgccagagagataattttcatgaacttctcactacgaagctcacgagttaccggcccaaaaatacgcgtaccgataggctgctcgctgttgttgttcagaagaacacaagcattaccatcgaagcgaatgacagaaccgtccgggcgacgaacacccttcttggtgcgcaccactaccgccttcagcacatcaccttttttgaccttaccacgcggaattgcttctttgatggtgatcttgatgatgtcgcctacgcctgcgtagcgacggtgcgagccacccagaaccttgatacacattacgcgacgtgcaccggagttgtcggcgacgttcagcatagtctgttcttggatcattttagtgctccgctaatgtcaactactactgagacccgaaaatcaggtcgttaaaaatccccatatcgagggcgcggcattataacaccgcttcaaggatatgggtagaaaaaataaacggctcatttctgagccgtttattcgtatcgagagagtgtactgtattacagaaccgctttctctacaacgcgaaccagcgtccaggatttagtcttggacagcggacggcattcgcggatttcaaccacgtcaccgataccgcattcgttgttctcgtcatgtacgtgcagtttggtcgtacgcttgatgaatttaccgtagatcgggtgtttcacaaaacgttcgatagcaacaacaatggatttctccattttgtcgctaacaacgcgaccttgcagagtacggattttatcggtcattacgcacccgccttctcgttcagtaaagtcttaacgcgtgcgacatcgcgacgcacttgcttcaacaggtgagactgttgcagctggccacttgcagcctgcatacgcaggttgaactgctcacgcagcaggttcagcagctcggtgttcagctcttcaacgctcttctcacgcagctcttttgctttcattacatcaccgtcttagttacaaaggtggttttaatcggcagtttcgctgctgccagcttgaatgcttcacgggccagctcttccggaacaccgtccatttcatacaggactttacccggctgaatcaaggcaacccaatactccacgttacctttacctttacccatacgcactgccagcggcttttcagtgatcggtttgtccgggaacacacggatccagatcttaccttgacgcttaactgcacgggtcatagcacgacgtgctgcttcgatctgacgtgcagtcagacgaccacggccaacagctttcagaccgaagctgccgaagctaacatccgtaccctgcgccagaccgcggttacggcctttgtgcattttacggaattttgtacgctttggttgtaacatcagcgacgctccttatttacggcctttacgctgctgctttttaggctgagcagccggtttttccggttgttcaacagcagccataccacccaggatctcgcctttgaagatccacactttaacgccgattacaccgtaagtggtgtgcgcttcagaggtgttgtagtcgatgtcagcacgcagagtgtgcagcggtacgcgaccttcgcggtaccattcggtacgtgcgatttccgcgccgcccagacggccgctaacttcaactttaatacctttagcgcccagacgcattgcgttctgtacagcacgcttcatagcacgacggaacataacgcgacgttccagctgagaagtgatgctgtcagcaaccagttttgcgtccagttcaggcttacgaacttcggcgatgttgatctgtgcaggaacgccagcgatgtccgctacgaccttacgcagtttttctacgtcttcaccttttttaccgataacgatacccgggcgagcagtgtgaatggttacacggatgctcttagccggacgctcgataacgatacgagatacggacgctttagccagttccttagtcaggtactgacgtactttaaaatcgctgtccaggttgtcagcgaattctttggtgttcgcaaaccaggtagagttccatggttttacaatacccaggcgaataccattaggatgtactttctgacccattgctagtctccagagtctcagcgatcggacacaaccacagtgatgtggctggtgcgcttcaggatgcgatctgcacgaccttttgcacgcggcataatgcgcttcatgctcgggccttcgtctacgaaaattttcgtaactttcagatcgtcaatgtcagcgccatcgttgtgttcagcgttagcaatggcagattccagaactttcttgaccagtacagccgctttcttgttggtgtaggtcaaaatatccagagcctgcgacactttcttaccgcgaatcaggtcagcaacaaggcgaaccttctgagcagaagaacgagcatggcgatgtttagcgatagtttccatctcttcctcctaccttatttcttcttcgcttttttatcagcagcgtggccgcgataagtacgagtcggtgcgaattcacccagtttgtgaccgaccatttcgtcggttacaaataccggaacgtgctgacgaccattatggacagcgatggtcaaaccgatcatgttaggaaagatcgttgaacgacgggaccaagtgcgcaggggcttcttgtctccgctttccaccgctttctctaccttcttcagcaagtgcaggtcaataaaaggacctttcttgagagaacgtggcatggcttatcctctaaaattatttgctacggcgacgtacgatgaatttatcagtacgcttgttgctgcgggtcttcttacctttggtctgaacgccccacggagttaccgggtgcttaccaaagttacgaccttcaccaccaccatgtgggtggtctaccgggttcatcgcggtaccgcgaacggtcggacgaacaccacgccagcgtgcagcacctgctttacccagaacgcgcagcatatgctcagcattgccaacttcgcccagagttgcacggcagtctgcttctactttacgcatttcaccagaacgcagacgcagggtgacataagcaccatcacgagcaacgatctgaacgtaagtaccagcggaacgtgccagctgaccgcctttacctggtttcatttctacgttatgaacagtagaaccaaccgggatgttgcgcatcggcagggtgttacctggtttgattgcagcatcaacgccagactgaatctggtcgccagctttcaggcctttaggggccaggatgtaacggcgttcaccgtctttgtacagaaccagcgcgatgttcgcggaacggttcggatcgtactcaagacgttcaacaactgccgggataccgtctttgttgcgtttgaagtcaacaatacggtaagcctgcttgtggccaccaccgatatgacgagtggtgatacggccattgttgttacgaccaccggatttgctgtttttttccagcaacggagcaaaaggtttgcccttgtgcagctcagggttaaccactttaactacgtggcgacgacccggagatgtcggtttacatttaacaactgccattgtattactcctccgacttactcagcgccgccaacgaagtccagattctggccttctttcagggtgacgtaagcttttttccagtcgctacgacgaccgatacgctgtccgtgacgtttaactttccctttaactaccagggtgttaacgacttcgacttcgacttcaaacagtttctgcacagcagctttgatttctgctttggtcgcgtctttagcaactttgagtacgatggtgttggatttttccatcgcagtagacgctttttcagaaacgtgcggtgcacgcagcaccttcagcagacgttcttcacgaatcatgccagcatctcctcaacttgcttaacagcatcagcagtcattacgactttgtcgaaggcgatcaggctaaccgggtcgataccagttgcatcgcgtacgtcaaccttgtgcaggttgcgcgcagccaggaacaggttctcgtccagctcaccggtgatgatcagcacatcttccagagccatgtctttcagtttctgtgccagcagcttagttttcggcgcttctacagagaacttctcgacaacgatcagacgatcctgacgtaccagttcggacaggatgcttttcagcgcgccgcggtacatcttcttgttaactttttgactgtggtcctgcggacgagcagcaaaggtcacgccaccagaacgccagatcgggctcttgatagaaccagaacgcgcacggccggtgcctttctggcgccacggttttttaccggaaccagttacttcagcacgagtcttctgagcacgagtaccctgacgagcaccagctgcataagcaacaacaacctggtgaaccagcgcttcgttgaaatcacgaccgaaggtagtttcggaaacagtcagcgcgctctgcgcgtctttcaatactaattccattgctatctccttacgccttcacagctggtttaacgatcaggtcgctaccggttgcacccgggacagcgcctttaaccagcagcaggttgcgctcagcgtcaacgcgtactacgtcaaggctctgaacggttacacgttcgttacccatctgacctgccattttcttgcctttgaacactttgcccggagtctggttctgaccgatagaacccggaacgcggtgagacaaggagttaccgtgagtagcgtcctgggtacggaagttccagcgcttaacggtacctgcgaaacctttacctttagaggtgccagttacgtcaacttttttaacgtcagcaaacagttcaacgctaatgctctgacctacagtgaactcttcgccttcagccaggcggaattcccacagaccacggccagcttctacgccagctttagcgaagtgtccagcttcaggcttggtcacacggttagcttttttagcaccggtggtcacctgaatagcacggtagccatcgttagccaggtctttaacctgagtaacgcggtttgcttcaacttcgattacggttactgggatagaaacgccgtcttctgtgaagatacgggtcatacccacttttttaccgactaaaccaatcattgtttcaacctctcaatcgctcaatgacctgattaacccaggctgatctgcacgtctacaccggcagccagatccagacgcatcagagcatcaacggttttctcggttggctcaacgatgtcaaccagacgcaagtgagtacggatttcgtactgatcgcgcgcgtctttgttgacgtgcggggagatcagaacagtgaagcgctctttgcgtgtcggcagcgggatcggaccacggacctgcgcaccagtgcgcttagcagtctcgacgatttccgcggttgcttgatcgatcagacgatgatcaaacgctttcaggcggatacggattctttggttctgcatgagaccagagctccaattattttataaacgaaaatgattactcctcagacccattacgattgatgggagagtgtaaccgttcttacgtagctccccgattgggagcattgttaggtagccaaattcggctaactgaggttcagattgaacctgctgtcaactacgacaagcccgcgcattatacatacttaaccaccgaacgcaagcgtattgctagtaaagtaaacagcctttgggttatctctcaagttcgttcagcgcatttttgacacgctctcttaaaccggctttctcgtcgctttcttctacagtattttcttcgtcttcagaagaagagggggcattctcagccgcgacgcctggttcatcttcctcctcgacggattcgacgacggggagtggctgttttttgaaaaaatagtgttgtgttgattgtttaaaagcgggcgtttcagcatctacagtgacttctgcttttactatccaaagtgcccatagctgccgggcatacccaccaaccaacaccattcctgcaaaccacaggcaaatcagcaataaacaaatgacatatattatggtgctgtgtttttgtcgggagaagataccagggtgacccgtttctttctgctcacgcgcggcgatatagaattcaaacatgtcatttccccttcactgttgtttctggggaaatatttgcttcatcccgatataagtaggcactctcccccgccacctgccagagatgtactaacgttgaaaagccaacaacaccgtcagttttcaagtgatggcttttttgaaattgctttattttttctaccaacaagggacgccactctgccgaagattctgtcgaaatatgcaatgcgcggtttaacatcgtttccagccagagaatctcttcctcgctgctatcacgcgtaatggtactctccccttccggcgacattttccacaacagaagataatcacccgtccataccaactcaaaccatttatgtgtcagcgtccaggtttgctgccctacgagtacatcaacggtagcatcaccgacgcgaacgaccacaacaggcaattttttgtccccgactttaagcgatgcgatccagggcaaattctgatctaccaatgtttgtaaagaagcgttcccacttttacataccagccccgctcttactgcctgatcgcaccaggccgaatcggctggaacctcgtacccccatacgccgtataacacgcttagcgcctcactatcgcgcatcaccacatgagcaatatccttagtcatatcttgtttaactactggcgttacgggtatcagccacgcaggaacgggtaacggagctgtgaaagaggacagcagtagccaaccacaggtaagtgcgagaatggttccactcatcaccacggcaagctgcattttccgggggcgcttatcacctaatacgcggtaaatcattcaccattgttttgcagtgaaaacgctggtctgctcggcttgctgtaataagctaattgtttcgccggcaagcgccagctttctgcgatctccccgacataataaagctatccgtttcagaactctggcggttaaaaggagatcgggctggtcaatattctgaccttcaaggatgcttgccttaagctcgtgctccgtcagacgacctgtcgagacaagttcaatgccctgttttttaaaatcacgttcaacttttcgatcgggtctgccgatcagcaaaaattgaccgtcaggaataagagatatcgcgcgttggagatcatcaagtatgcggcggtgattcaggtgagcattttcaataataataagagggcagcgactatcagttcgatgaagtgcatgcagtaattgacccgccatctcatctcgcgtccaggcgctgtcacggcagccctgttcagccgcattatcgtcggtaacgatccatgcggccttaccttgccaggaaacaacgaggcttaaagtaatcacacggcgatgtttatctttttgtagttgctgcgccagccaggtttttccacttccagcctcacccaacaaatagcacagacgccaggtctgacgtttctcacgcaaccaggaaagaatgacttctcttctcgtagacatagaacttcctgttttaattattgattatccttaatcataaaaataatgtatgtatttattaattaaatacatattactaatataaataaattttgcttgattcatgcaagcggcattaatactatttatactaacgtcaatatacaacccacccaatctattttattagaacatacatcgtgcccacactacctttccctttccatctggcgaatcataataaagatgctgccatcaatatattgattatatttataagcatagggttgattatttttaatgtgaattatttccatacaactatagttaaaaatgaacagatcattaatcaaccaacaaatgcatttcagtctgaattcagccttgccgctttatggcgcaacgaaaatcatgctggggtaaaagatgcaaatcccgtggcagttaatcaggaaacacctaagctctctatagcgcttaatggcattgtactcacatcgaatgatgagacttcttttgtcttaattaatgaggggagcgaacaaaagcgatactccctcaacgaagcccttgagtcagtgccgggaacgtttattagaaaaataaataaaaccagcgttgtgtttgaaactcacgggcattacgaaaaagtaactctccatccagggctacctgacatcatcaagcagcctgattcggaaaatcaaaatgtactcgctgattatattatcgccacacctatacgtgatggagaacagatatacggtcttcgattgaatcctcgtaagggtctcaatgcatttaccatcagcttgctgcaacctggggatatcgccctcaggatcaataatctttcgctgacccaccctgatgaggtttcacaggcattaagtttactgctaactcaacaaagtgctcagtttacaattcgtcgcaacggcgtaccccgcttgataaatgtttccgtcgcggaacttacaggaatgaatggacagcgcaatgaagggactcaataaaatcacctgctgcttgctggcagcactacttatgccttgtgcagggcacgctgagaacgaacaatacggcgctaacttcaataacgccgatatccgccagttcgtggaaatagtgggtcagcatcttggcaaaacgatcctgatcgacccttcggtacagggaaccatttccgtacgcagtaatgatacgtttagccaacaggagtactaccagttctttttaagtattcttgatctttacggttattccgtgatcacgctggacaatggttttctgaaagtggtgcgctcagctaatgtaaaaacatcgccagggatgattgctgacagttctcgtccaggcgtaggtgatgagttggtcacccgaatcgtaccgcttgagaacgttcctgctcgtgacctggctcccctgctccgccagatgatggatgcgggtagcgtcggtaatgttgtgcattatgaaccctccaacgttcttattctgaccggtcgtgcctccaccattaataaactgattgaagtcataaagcgcgttgatgtcatcggcacagagaagcagcaaattattcatctggaatatgcatcagcggaagatctcgccgagattcttaatcaattaatcagcgaaagccacggtaaaagccagatgcctgccctcctttccgcgaagattgtggcggataagcgaaccaactctcttatcatcagcgggccggaaaaagcacgccagcgcataacttcattactgaaaagccttgatgtagaagagagcgaggaaggaaatacccgggtctattacctgaaatatgctaaagccacgaatctggtggaagtgctaaccggtgtttccgaaaagctgaaagatgaaaaagggaattcgcgtaagccttcttctacttctgcgatggataatgtggccattaccgccgatgaacagaccaactcgttggtcattaccgctgaccagtccgtccaggagaaactcgccacggtaattgcgcgtctggatattcgccgtgcacaggtgctggttgaggcaatcatcgtcgaagttcaggatggaaatggactcaacctcggcgtgcaatgggcgaataaaaacgttggcgcacagcaatttaccaatacgggattaccggtttttaacgctgcgcaaggtgtagctgattataaaaagaatggcgggatcaccagcgcgaatcctgcctgggatatgtttagcgcctacaatggcatggctgcaggcttcttcaatggcgactggggcgtattgttgactgcgctggccagtaacaataaaaatgacatcctcgccaccccgagcatcgtaacgctggataataaactcgcgtccttcaacgttggtcaggatgtgccggtgctatccggctctcagaccacttctggggataacgtctttaatactgtcgaacgcaaaacggtgggcacaaaactcaaagtcactccgcaggtcaatgaaggcgacgcggtactgctcgaaatagagcaggaggtttccagcgttgactcttcgtctaattcgacgctcggcccgacatttaacacccgtactattcaaaacgccgtgctggttaaaaccggtgaaacggtggtcctgggcggattgctggatgatttttctaaagagcaagtgtcaaaggttcctctgcttggcgatattcctttagtgggacaactcttccgctatacctcgaccgagcgcgctaaacgcaacctgatggtatttatccgcccgacgattatccgtgacgatgatgtttatcgctcactgtcaaaagagaaatacacccgctaccgtcaggagcaacagctgcgaatcgacgggaaatcaaaagcgctggttggctcggaagatttgccggtgctgaatgagaacacgttcaacagtcacgcccctgcgccatcgtcacggtgaggcattcttatgagaattcactcaccgtaccccgccagttgggcgctggcacaacgaattggttatctctattcagagggcgagattatttatctcgccgatacgccattcgaacggttactcgatattcaacgtcaagttggccagtgccagaccatgaccagcttgtcacaggctgattttgaagcccgactggaagcggtgttccatcagaataccggtgagtcgcaacagattgcgcaggatatcgatcaatccgtcgatcttctctcgctttcggaagagatgcccgcaaatgaagatctcctgaatgaagattcagcggcaccggttatccgcttgatcaatgctattttgagtgaggccatcaaagaaaccgcctccgatatccacattgaaacctatgaaaaaacaatgtcgatccgttttcgcatcgacggcgttttgcggacaattttacagcccaacaaaaaactggcggcactgcttatctcccgaattaaggtcatggctcgtcttgatatcgccgaaaaacgtattccacaggatggaagaatcagtttgcgtatcgggcgacgtaacatagatgtccgcgtatccacactgccatccatctatggtgaacgcgctgtgctccgcctgctggataaaaacagcctccagctttcattgaacaacctggggatgacggcagcggataaacaggatttagaaaatctcattcagcttccgcacggtattatcctggtaacagggccgacaggctccggtaaaagcaccacgctctacgccattctttcggcgcttaatacccctggccgtaatattctgacggtagaagatcccgtggaatatgaactggaaggcataggacaaacgcaggtgaatacccgcgtggatatgtctttcgctcgcggcctgcgcgccatacttcgccaggacccggatgtcgtcatggtgggggagattcgtgatacagaaaccgcgcaaattgcggttcaggcctcgctcacaggccatctggtactctcaacactccacactaacagtgcatcaggcgcagtcacccggctacgcgacatgggcgtcgaatcattcctgctttcgtcttcactggcagggattatcgcgcaacgtctggttcgtcgtctgtgtccgcaatgccgacaattcacgcccgtatcgccccagcaagcgcagatgtttaaatatcatcagctcgcggtgacgacaattggcactcccgtaggctgccctcattgccatcaatccggctaccaggggcgcatggcgatccacgaaatgatggtggtgacgccggaattgcgggccgctattcatgaaaatgtggatgaacaagcactggagcgactggtccggcaacaacacaatgccttaatcaaaaatggcctgcaaaaagtgatacgcggtgacacctcctgggatgaggttatgcgcgtcgccagtgccacgctggagaacgaagcatgaattatcgctatcgcgccatgacccaggatggtcaaaaattgcaggggatcattgatgctaacgatgaacgtcaggcacgactgcggctgcgtgaagaagggcttttcctgttggatattcgcccccaaaaaagttcgggagtaaaaacacgtcgcccgaggatcagccatagtgaactaacgcttttcacccggcagttggcaaccttaagcgcagcggcattacccctggaagagagccttgctgtaattggtcaacaaagcagtaataatcgactggctgacgtgttaaatcaggtacgcagcgccatccttgaagggcatcccctttccgatgcgttacaacattttcccacgcttttcgattcgctctaccgtaccctggtaaaagcgggcgaaaagagcggtctgctggccccggtgttggaaaagctggctgattacaatgaaaaccggcagaaaatccgcagcaagctcattcagtcactgatctacccctgcatgctcactacggtggcgattgtggtcgtgattattctcctcactgctgtcgtgcccaaaattaccgaacagttcgtgcatatgaagcagcaactgccactgagtacacgcattcttttaggtctgagcgacacgttgcaacgtaccggcccgacattattagcgacagtatttattgtcgctgtgggtttctggctctggttaaaacgcggcaataaccgccaccgttttcatgccatgttactgcgcgttgcgctcatcggcccgctgatttgcgccattaacagcgcacgctatctccgcactttaagtattttgcaatccagcggcgtccctctgctggatgggatgaatttgtccaccgaaagcctcaacaacctcgaaattcgccagcgcctggcaaatgcggcagaaaacgttcgccagggtaacagcattcatctttcactggaacaaaccgcaattttcccgccgatgatgctctacatggtggcctctggcgaaaaaagcgggcaactcggcacgttaatggtcagagccgcagataaccaggagacactccaacaaaatcggatcgccttaacgctctccatcttcgagccagcactcattattacgatggcactgatcgtcctgtttattgtcgtgtcggtactccaacctcttcttcaacttaactcaatgattaattaaggaaatcatatgcgcgcaacggataagcaacgcggttttacattactggaaattatggtggtaattgtcatcattggcgtactcgccagcctggtggttcccaacctgatgggcaataaagaaaaggcggataaacaaaaagccgtcagcgatattgtggcgctggaaaacgccctagatatgtacaagctcgacaatcatcgctatccaaccacaaatcaggggcttgaatccttagtagaagcgccgacactgccaccgctggccgcaaactataacaaggaaggttatatcaagcgtctgcctgccgatccctgggacaatgattatgtcctcgttaatcctggtgaacatggtgcatacgatctgctttcagcaggacccgatggtgaaatggaaaccgaggacgacatcaccaactggggtttgagcaaaaagaaaaagtaagtcagcgatgaatcagcaacgcgggtttaccctgctggagatgatgctggtgctggcgctggtcgctatcacggcaagtgtggtgctcttcacatatggtcgggaggatgccgccagcactcgtgcgcgcgaaacagcggcgcggtttaccgctgcacttgaattagccatcgaccgcgccacgctcagtggtcagcctgtcggtatccatttctctgattcagcatggcgcattatggtaccgggcaaaacaccatcagcctggcgctggggtccattacaagaagatgccgcagacgagagcaaaaatgactggggtgaagaactctcaattcaacttcagccatttaaacctgatgacagcaaccaaccgcaggtggtgattctggccgacggacaaatcacgcccttctctttgttgatggctaatgccgggaccggtgagccgctcctgacgttagtcagttcaggctcatggcccctggatcaaacgctcgccagagatacccgcccatgaacaaacaatcagggatgacactgcttgaagtcttactggcgatgagtattttcaccgctgttgcgctgactttaatgagcagtatgcaagggcaacgaactgccatcgagcggatgcgtaatgagacgctggcattgtggatagcggataaccagcttcagtcacaagactcattcgacgaggaaaacacgtccagttctggcaaagagttaataaatggcgaagagtggaactggcgcagcgatatccactcaagcaaagacggcacgcttctggaacacaccataacggtgacattacccagcggtcagacaacctcgcttacgcgctatcaaagcatcaataataaatccgggcaggcacaagatgattaatcgccagcagggtttcacattgctggaagtcatggcggcgctggcgattttctcaatgcttagcgtgctggcgtttatgattttttctcaagcttccgagttgcatcaacgttcacagaaagaaatccagcagttcaatcagctacagcgcaccatcaccattcttgataacgatctcctgcaactggtcgcccggcggaatcggagtacggacaaaatcatggtgttgggtgaagaagcgatttttaccacgcaaagtcgcgatccgctggcccctctcagtgaagcacaaaccttactcactgttcactggtatctgcgaaatcatacgctctaccgtgctgttcgtacttctgtggatggcaggaaggatcaacccgcccaggcgatgctggaacatgtcgagagctttcttctggaaagtaacagcggagaaagccaggagcttcctctctcagtcacgttacatctgaagactcagcaatatggggcgttacagcgccgttttgcattacctgagcagttagcgagagaagagtcgccagctcagacgcaggccgggaataataaccatgaataatgaacaacgcggcgtagcactgctcattgtactcatgttactggcgctcatggctgctctggctgcagacatgacgatcagttttcacggccagcttcatcgaacccgccaggtaaaccatcatttgcaacggcaatatgatattgagctggcggagaaacttgcgcttgccagcctcacccaggacgttaaagataacgacagacaaaccacgttgcagcagtactgggcacaaccgcaacagttgcagctggaaaatggcaatacagtgaagtggcagttacgcgatgcccagcactgttttaatctcaatgccttagcaaaaatctctgacgccccgctggcttcccctgatttccccgtccaggtattcagtgccctgctgattaacgccggtatcgatcgcggaaacaccgatgagatcgtgcaatcaatcgctgactatattgatgccgatgattcgccacgctttcacggcgcagaagataacttttaccaaagccaaacgccgcctcgccatagcgccatagaggcctttcagctgcgcatgcaggttggcaatcgcagacgttgcacacttaccgtggatgttctggccttcggtgtttgcagactgacaaatagcgttaccgtagtccattgtcatcacgttcacacccgccagctcaacacctttcgctttggcatcgctcaggacattcatcccttccggcgtcagacctgtcggcagaattggcaaggtataccagatagcaatatctttgccttctgacttccatttatcctgcactttcttcacagcaaggttacgacgttcaatagatgcctgatccgcaacccaggtgccttcgatatcgaagtccaggactctgaggttcaggttatcaacgatgtcataataatgctgcattagatcgtcaacgttcttacaggaagctgccagcggggcattattagcaccaccgatagacagcatcacatcaccgccagcctcacgcagagctttgattttgctgtactgagcgtaattctgcataccgtaagcggtaccccatgtcggtagacaggtgttcgcatctttactcaccacaaacgccagcgtgaagtggttgacgttatgattcttagccagcgcagccaaatccgggatcgtattcagcgtaaagtcgacatacggtgcataaacgtgtttcggccacgctttcttcggcgtacctacgcgctctttggttccggtccagtcaacaaaaacacgccacgggttgctgtcagaaggagaaactttctgcactttactctgagaaatgtagttctcaccgttaaagcgaatcagcgtatcactggcataaagcgtttctggattaaactgcggcgcattattcagctcttcgttgctatagctctgagtcttacctaacggcttccacgggcgactattgctaccggtggcgttttggttcgcaatcagagcagggttgtcactttgcgtccagaacagcgcttcataagcctgcccatcaacaacaacgcgatcacctttcacgtacacggtggaagcggaccatgctttcgccggttcgtatttcttccacgggttatcgccgccggggacaaagccccatgcgtcttgatcgacagaggttttataatgtgcatcgttataatctacgatgctgctcgcgctgtacgctttgctggcctggaaaccatccgcaataatgacgccgccattatcaatttcacaggtagtcgggttaccgtactgactcatttccgcagcggtagctgtacgcacgaggcgccatgggttattggagttttctacactggtgccacgcgggcaatcttcagaaccaacccaccaggcattctgataaacattaccattgaagataacatggtaaatttcgctgccttcctggccactccacgcctgcagtgagtaatcgttactgctatccgctggtgttgatggctcgttgttatccggagttggagtaactggagtttccggtgtttccggagttggatcaaccggagtcacagcaccgccattattatccggcttaacggaacaggagcctgggttaccatactgagtgatttctgttgccgttgccgcgcgaacataacgccatgggttgctggcatcgttttctttcgcatcgcctgggcaatttgccgcgcctacccaccaggcgttcttataaatgctgccgttgtagataacgtaccatgtagaagaaccttcctgacctttccaggctacgacagcatagttgtcgtttgacttatcagctggggctggctgaacatcaggagccggtttaacgtccggtgccggtttcacatccggtgcaggctgtggtgctgaagtacaagactgtggattactggtttctgagatttccgttgccgtagcggcacgaacataacgccatgggttgctggcatcattgcctttcgcatcacccgggcagttagaagaggctacccaccaggcatttttatataccgcaccattaaagacgacataccaggtttgaccgccctgctgtttattccaggcaactacagaagaattagacggaacagtgccctgtgctggtgtagccgaaccgccattagcaggcgtattagatgctggcgtatttgaagttgaagaagatgagcttccgctcttttcgcaggaaagtgtattgccaaactgactaatttcagcagctgttgcggtacgctttaaacgccacgggttagttgcatcatttgctttcgcttttcccgggcaatttgtagaagaaacccaccaggcattttcataaattttgccatcgaaaataacctgatatttattaccaccttgttggttattccatgcttccattgccaatgctggcagagcggaacacaccagccccataccaatcatagatttagtaaatatatttaatttcattataatcccttgtaacgtaaaaactgcaaaacaaaagtcctacgcaggaattatttacgttttacgagaacccttcaatatgaattaaagtgcggcatgaaaaataagaaaaaagcctgacaaatgaagcattttaaaaacagaaacattcatatttaaaatattaaattgaattgatattttaagtatgaataatttattcgttctgacagtacgaataagatatgcagtcaacaaatgcaaaaagggcgccgaagcgcccttttcaattcaaaactaattaacgtgtaattagcccagaactttagcaacaacgcccgcgccaacggtacggccgccttcacggattgcgaaacgcagaccatcgtccatcgcgatcgggtggatcagggtaacaaccattttgatgttgtcgcccggcattaccatctctacgccttccggcagttcgatggtaccagtcacgtcagtagtacggaagtagaactgcggacggtagcctttgaagaacggagtatgacgaccgccttcatctttggacagaatgtacacttcagattcgaacttggtgtgcggcttgatagtgcccggcttagccagtacctgaccacgttcgatttcttcacgtttgataccacgcagcagaacacctacgttctcaccagcacggccttcgtccagcagtttgcggaacatttcaacgccagtacaggtagacttctgagtctctttgataccaacgatttcaacttcttcaccaactttgatgataccgcgttctacacgaccggtaacaacggtaccacgaccggagatggagaatacgtcttcgatcggcagcaggaacggcttgtcaatcgcacgctctggttccggaatgtaagaatccaggaagccagccagttccaggattttcgcttcccactctgcgtcgccttccagcgctttcagagcagaaccacgaacgatcggagtgtcgtcgcccgggaagtcgtactgagacagaagttcacgaacttccatttcaaccagttccagcagctcttcgtcatcaaccatgtcgcatttgttcaggaacacgatgatgtacggaacgcctacctgacgacccagcaggatgtgctcacgagtctgcggcatcgggccgtcagtcgcagcaactaccaggatcgcgccgtccatctgagcagcaccggtgatcatgtttttaacatagtcggcgtgccccgggcagtctacgtgcgcgtagtgacgggtcggggtgtcgtattcaacgtgagaagtgttgatggtgataccacgagctttttcttccggcgcgttatcgatctggtcgaatgcacgagcagcaccgccgtaggttttagccagtacggtggtgattgcagcggtcagagtagttttaccgtggtcaacgtggccgatagtaccaacgttaacgtgcggttttgtacgttcaaatttttctttagacacggctatattccttactatagtgctctccccttcaggagagagcacgggactttggtattaacccttaggcttatttaccacgggcttcaattacggcctgagcaacgttactcggcgcttcatcatacttcaggaattccatagtgtatgatgcgcgacctttggtcagagaacgcagctgagttgcatatccgaacatttcagacagcggtacttcagcgtggatcttaacgccagtaacttcagattcctgacctttgagcataccacgacgacggctcaagtcaccgataacgtcaccggtgttctcttcaggagtttctacttcaaccttcatgatcggctcaagcagaactggtttcgctttcttaaagccttctttaaaggcgatagaagcagccagtttaaacgccagttcagaggagtcaacgtcatggtaagaaccgaagtgcagacgaatacccatgtctactaccgggtagcctgccagcggacctgctttcagctgttcctggatacctttatcaacggccgggatgtattcgccagggattacaccacctttaatgtcgttgatgaactcgtagcctttcgggtttgaacccggctccagcgggtacatgtcgataacaacatgaccatactgaccacgaccaccagactgtttcgcgtgtttaccttcaacatcggtaactttctggcggatagtttcacggtaagcaacctgcggtttacctacgttcgcttcaacgttgaattcacgcttcatacggtcaacgatgatgtcgaggtgcagttcgcccatacccgcgatgatggtctggttagattcttcgtcagtccatacacggaaagacgggtcttctttagccagacggcccagagccagacccattttttcctggtcagctttggttttcggttcaactgcgatggagattaccggctcagggaattccatacgttccagaatgatcggcgcatccgggtcacacagggtgtcaccagtggttacgtctttcagaccgattgcagctgcgatgtcgcccgcgcgaacttctttgatctcttcacgtttgttagcgtgcatctgaacgatacgaccgaaacgctcacgtgcagctttcacggagttcagtacggtatcaccagagttaaccacaccggagtacacacggaagaaggtcaggttaccaacaaacgggtcggtagcgattttgaacgccagtgcagagaacggctcgtcatcacttgcgtgacgctcagccggagtgtctttaccgtcgtccaggataccgttgatcgcaggtacgtcaaccggggatggcaggtaatcaattaccgcatccagcatcgcctgaacacctttgttcttgaacgcagaaccacaggttaccaggatgatttcgttgttcagaacgcgctgacgcagagcacctttgatttctgcttcagtcagttcttcaccacccaggtatttttccatcagctcttcagaagcttcagctgcggattcgatcaggttctggtgccattcgttagccagttcaaccatgtctgccgggatatcttcgtattcgaaggttacgccctggtcagcgtcgttccagttgatagctttcattttcaccaggtcaacaacaccggtgaaatgttcttcagcaccaatcgccagctgcagcggaaccgggttcgcgcccagacgggttttgatctggttaacaactttcaggaagttcgcacccatgcggtccattttgttaacgaacgcaatacgcggaactttatatttgtttgcctgacgccatacggtttcagactgcggctgaacaccaccaactgcgcagtaaaccattaccgcaccatcgagaacacgcatggaacgttctacttcgattgtgaagtcaacgtgccccggggtgtcgatgatgttgatgcgatgcggctcatactgcttagccataccagaccagaatgcagtagtcgcagcggaagtgatggtaataccacgttcctgctcctgctccatccagtccatggttgcagcgccgtcatgaacttcaccgattttatggtttacaccggtgtagaacagaatacgttcggtagtagtggttttaccggcgtcgatgtgcgcactgataccgatgttacggtagcgtgcgatgggtgttgtacgagccatttgtttcctcgtttatcttttaggcgttcaatttaagtagcccaaagcgggctgcttactggaagcgcccgcctggtgactaaaactccgaagggattaccaacggtagtgtgcgaacgccttgttggcttcggccatacggtgaacgtcttcacgtttcttaactgcagtacctttgttttctgcagcatcagaaagttcgttcgccaggcgcagagccatggatttatcaccgcgtttacgagcagcttcaacgatccaacgcattgccagagcattacgacgaaccggacggacttcaactggtacctgataagtagaaccaccaacgcggcgagacttaacttctacagtcgggcgcacgttttcgagagctacttcgaatgcttccagttcagatttaccagagcgctgagccagggtctccagcgcgctgtatacgatagattcagcagtagattttttaccatctaccatcaggatatttacaaatttagccagcagttctgatccgaacttcggatccggcagaattttacgctgaccaatgacgcgacgacgtggcatggaaatactccgttgttaattcaggattgtccaaaactctacgagtttagtttgacatttaagttaaaacgtttggccttacttaacggagaaccattaagccttaggacgcttcacgccatacttggaacgagcctgcttacggtctttaacgccggagcagtcaagcgcaccacgtacggtgtggtaacgaacacccgggaggtctttaacacgaccaccacggatcaggatcacggagtgctcctgcaggttgtgaccttcaccaccgatgtaggaagtcacttcgaaaccgttagtcagacgaacacggcatactttacgcagcgcggagttcggttttttaggagtggtagtatatacacgagtacatacgccacgtttttgcgggcatgcttccagcgcaggcacgttgcttttcgcaactttgcgagcacgtggtttgcgtaccagctggttaactgttgccattaaatagctcctggttttagcttttgcttcgtaaacacgtaataaaacgtcctcacacaatatgaggacgccgaattttagggcgatgccgaaaaggtgtcaagaaatatacaacgatcccgccatcaccaggccatctggctggagtgcttaaccgtaagtctgacgaaatcagtatagtcaatggaaatgatgtcgttcgaaattcgaccagtcaaaccgcgggcaataaggtcttcgttcagagcatagaccttaatgggggcattacgcagactttcaaggtagcggttgccgtcaactgcggcagttacgccatcttgcaataatagcagttcgtcaccttcactgagcagacgcagcagcgcagcaaagtccgtcagccagggtgaacgatgtaatgtgtgcagcataacgcctcaaaacctcaaaataacatcgtagttggcgagttcgcggcgtaaggcatctgcttcgagcggcgtggcttcgaccacaaagggtgtctgcggatctaacccacgttcgcgcagtgaagccgcgcaaatccagcactgttcaatatcgtacagacccaacaatttaaaagtggcaatgtaatcacgcgccagcactgcatcgggcttttgtcctggcagcagctgaaaaacgccatcagcaataaagaagacggccagatcgtcagttaatgcggaagttgccagtaaagcatctaaaccttcccggcctgcagttgtaccatgaggcgcagtagaaaaaacaaacgcaattcgtttcatcagaactgtaccaccctgtcacaggtcagcgaggcttccgccagcgcgccaagtccgcttaaggtaaatcccggctgaaggtttgacgaagctagccccagtcttccggcctccgtttcatcaacaacgccacggcgtaatgctgccgctacgcagatattcagcgccacaccatgttgcgcattcaactgttgccagccgcgcacaaggtcaaattcgtcgcttgccggtgaggtcaattggttagcgttatagaccccttcccgatagaaaaaaacgctgcttaactcatggccttctgctatcagcgcctgcgcaaactgaaaagcactactcgcctgttgcgtaccgtatgctggcccggtcaccacgatggcaaaacgcattacttatcttgcccctggaaatcaccgctcttgaactggcggatgtagagatagacagtgtgtttggagatgttcaggcggtcagcaacctggttgatcgcgtctttaatatcgaagatccctttctcgtagagatttagcacgatctgacgatttttggcgttattagaaacattgcgatcggcattcacttcttcgatggtgaactccagcgtttgggtaaccagatcttcaacagaagaggcaaagttgacgcttgaaccgacatccggagtttccggcggcacaaaagtgctcataatctgcgagaagggaacatcaagattcatattgatgcacagcagaccaattacacgctgttcgcggttacgaatcgcgatagtcagggacttcattaatacgccgcttttggcgcgagtaaagtagcatttagaaacgctgctatccgctcccgtcatatcgtgcagcatacgtagcgccaggtcagtaattggcgaaccaatcttccggcctgtatgttcaccgttagcaatgcgaatggctgaacattttagatcctgcaaagagtgcaaaacgatttcacagtgggagccaataagcatcgctaacccgtccaccaccgcttcgtaggatttcagaatatcaaaatcggtctggtcaaaaggacgttgatccagtaaatccaactcactggtttcgttggttaaaagcgacctggacatgaaaaaaaacactccttttcaggagcctgtcgttaacttttcagggcaggctcattaatgatgcgggtaactaaattaatacagcggaggttccgctttccagcactaattatatccggcctgtaataaaaaaaccgccgcctggtcaggcggcggttcttaatgcttattttttagcagagtctgcggctttcgcattagcttccggctttgcatcagccttcggcgctggtttcacatccagcagctctacgtcaaacaccagggtagaattcggtgggatccccggaacacccgctttgccgtaagccagttctggtggaataaccagtttgatcttaccgcctttcttgatgttcttcagaccttctgtccaacccgggataacaccgtccagacggaaagagagcggttcaccacgggtgtaagagttgtcgaactctttaccgtcgatcagcgtacctttgtagttcactacaacagtatcgctgtctttcggtgcttcgcctttaccggcttctactacctgataaaccagaccagtggaagaggttttcacacctttctctttggcaaatttctcgcggtactctttaccttttgcttcgttatcagccgcgtctttttccatcttcgcctgagcagaagacttcacacgagcttcgaatgcttgcagagtctgttcgatctcttggtcggaaagtttgctcttatcagcaaatgcatcctgaacaccagcgatcagctgatctttatccagtttgatgcccagtttttcttgttctttaagagagttttccatgtaacgacccagcgaagcacccagtgcataagctgatttctgatcgtcatttttgaacgctgctttgctgtcagcagttgtagcaggttttgcagcttcagcagcaaaagtgattggtgcatgcagggcaacggccattgtggtcgccagcagcgttactttaaacagtgatttcatccatatctccaggatcggggcatctcaccccagggttaactattatcagaagggtactataaagcgttgtcgaacaaatctacatacagacacgccctattatcatctattttcagactctttttgtttaaattagtttcgatgaccgcgaaatgagtgctgtctcgggcagcaaagttaagtagaatccgcggcgaccattcgacaaaagaggtgaatcatgcaggatttatcattggaagcacgcctggcagagctggagagccgactggcttttcaggaaatcaccattgaagaactgaacgtcacggtgaccgctcatgaaatggagatggcgaaactgcgcgatcatctgcgtctgctgaccgagaagctaaaagccagccagccgtcgaacatcgcgtcgcaggctgaagaaacgccaccgccacattattgaggcgtaaaaaaagcggggattccccgcttttttgtcaccttttcggtattagtggcaaccgcaaccgccgttgcctttaccgccacagcagccttcgccaccgtgttcatgaccgtgatcgtggccatgaccaccgcagcaaccgtcgtggtcgtgatcgtggtggtgatcgtgcgcgccgtgaacgtgaccatgagccagttcttcttcggtcgcttcgcgaatcgccacaacttcaacgttgaatttcaggttctgaccagccagcatgtggttaccatcaaccactacgtgatcgtcttcaaccgcagtgatttcaaccggtaccggaccctggtcggtttcagccaggaaacgcatacctacctgcagttcatcaacgcccataaatacgtctttaggaacgcgctgcaccaggttttcgtcgtactgaccgtaagcgtcgttcgcgccaacagcgacatcaaatttgtcgccaacttcatgaccttccagcgctgtttccaggccagagatcagggaaccgtgaccatgcaggtagtccagcggcgcactcaccggagactcatcaaccaacacaccgtcttctgtacgtacctgataggccaggctgaccaccaggtcttttgctactttcatgatatctcctgagcatgggaagaatagtggcgcagattgtagcggaattctgcagccgtgtactcactagcttaaaaaaactcggcgcatatcgctagtccggatgaaaaatcccgatcacttgctcatctttgcggacgtgatcgcgggcttctttgtctgcttctcgcatctgatgtccacacttaacacattctacgatatcaatattattttcgcgccacatcgccattgaatcctgtgcctgacaggccgggcattttgcgcccgcaataaaacgttttcggattgccatctttaccctctactcaaattcatcccagccgtccagctggcgtcgttcttgttgcatttcacgctggaaaatctcttccagttcacgtcgggcttccctggcgcgagaaatttgtacggtatcagcatgcatcgggattaactcccgcagcattcgcatatccaggcggcgaaaatgcagttgcgcgcgctgcgcctgatgcggatgcatgccaagcgtgaccagcgtcttgcgccccagctctaacgcactggagaatgtttcacgggaaaactgcgtcacccctgcctgtaataactcatgcgcttccacacgtccgcgcgctcgcgcaagaatatgcaaatgcggaaagtgctgctggcatatttccaccagcttcatagtgtcttccggctcgttacaggtaatgacgatagactcagcggcctctgcacccgcagaacgtaaaagatctacctgcgtggcgtcgccgtaataaactttgtagccatatttgcgcatcaggttaacggcactgatatcccgctccagtacagtaatgcgcattttatttgccatcagcaaacgaccaatcacctgaccaaaacgcccaaagcccacgacaatgacctgcggtttatcatcgttgacccatggtttttcgtcttcttcttccggtccgttaaactggcgggatagccatttatcgaccagcttcatcagcagcggcgtggtcatcatggaaagcgtcaccgtcaccagcaacagcgccatctggtcgccctggaataagcgttgtgaagaagcggtagaaaagaggacaaaggcaaactcaccgccctgactcaacacgccagcaaactgcatccgctcagaactgcgcacgccatacaatcgcgccagcagatacagcacgagaattttcaccgccaccagcacaaccacacttatcactacccacaacagatgggtataaagcaccccgaggttgagcgacatgccgacagagataaagaacaaaccaagcagcaagcctttgaagggatcgatagccgtttccagttcatggcgatattcactttccgccagtagcacacccgcaataaacgtaccgagcgccatcgacaaccccagcgcatccataaacaatgcggaacccaacaccagcagcagcgtcgcggcggtgaacacttcccgcacaccagaagctgcaataaaacggaataccggacgcagtaaatagcgcccgccaatcagcatgccgacaaacgccagcaccttcatgccgatcttcatccagtcgaaatgttcgtctgccgaacccgccaacaacggcactaacgccagtgccgggatcaccgccagatcctgaaacagcagtaccgagaaacctaactggccggattcgctgcgattcatccctttctcacgcatcaattgcaacgccattgcagttgaagacatcgcaaggccaatgccaccgaccaccgccgcctgccatgagaaatgggtcagcatcaataatcctgccagcaacgccgagcttaacagcacctgtgccgcgcctacgccaaaaatcgaacgccgcagttgccaaagcttggagggattcaactcaaggccgatgataaacatcaggaataccacgccgagttccgaaaagtggaggatctcatcgacgtcgctaataaaccccagcccccacgggccaatcgcaatccccgccagcaaatatcccaacactgcaccaatacccagccgcgatgccagcggcaccgcagccaccgccgcgaagagaaacagcactcctgcgagtaaaaaatcagaaccttccatcagcagcctcctggagacagcggatttgccagccagtcaccgtaggctctggcgtggctcgccagctcctgtgcgctttgccgtctcgcccagtaaataatgatggggcttaaccaatgcatccggcacatgcccgccgccagttcaaaggggcgcagaacatcgctcatcgggtagcgattcaacgcgtcataacggtaagcactttccggctccccggtggtaatcacgctacgccagtactttcccgccagttggtttccccccggtccgctggcaaaaccacggcttaatacccggtccagccactctttcagtagcgccgggcagctataggtataaagaggatgctgaaagacaatcacctcgtgctcgcgcagtaatgcctgctcacgagggatatcaataaaaaagtcgggatagtgcgcgtaaaggtcgtgcacggtaacattgctgagctgcgtggccggtttaagcagaacccggtttgccaccgagtcctgagattccggatgggcatacagcagcaaaactttcgctggctgagacatcatccccctcccggtatggtttttgtgtatagtcgctgttttgggctaccattgcgcccggtgcggcagctcgcccatacattacattatcataatgataagttaacatagtctgaacatacggcgccttatgattgttttttcctcgttacaaattcgtcgcggcgtgcgcgtcctgctggataatgccaccgccaccatcaaccctgggcagaaagtcggcctggtgggtaaaaacggctgtggtaaatctaccctgctggcattgctgaaaaatgaaatcagcgccgacggcggcagctacacctttccgggaagctggcaactggcgtgggtgaatcaggaaacaccggcgttaccgcaagcggcgctggaatatgtcattgacggcgaccgtgaatatcgtcaactggaagcgcagctacacgacgccaacgaacgtaacgacgggcacgccattgcgaccattcatggcaagctggatgctattgacgcatggagtattcgctcccgtgccgccagcctgctgcacggcctcggtttcagcaatgaacaactggagcgcccggtaagtgatttctccggtggctggcgtatgcgtcttaaccttgcccaggcgctgatttgccgttcagacttgctgctgctcgacgaaccgactaaccacctcgatctcgatgccgttatctggctggaaaaatggctgaagagctatcggggcacgctgatcctgatctctcacgaccgcgacttcctcgatccgatcgttgataaaattattcatatcgaacaacaaagcatgttcgagtacaccggcaactacagttcgtttgaagtacagcgcgccacccgtctggcgcagcaacaagcgatgtatgaaagccagcaggaacgcgtagcgcatctgcaaagttatatcgaccgtttccgtgccaaagccaccaaagcgaagcaggcccagagccgcattaagatgcttgagcgtatggagctgattgcccccgcgcacgtcgacaacccgttccgctttagcttccgcgcgccggaaagcctgccaaatccgttactgaagatggaaaaagtcagcgcaggctatggcgatcgcattattctcgactcgattaaactgaatctggtccccggctcgcgcattggtctgctaggccgcaacggcgcgggtaaatcgacattaatcaaactgttagccggggaacttgcgccagtcagcggtgaaattggtctggcgaaagggatcaagctcggctacttcgcccagcatcaactggaatacctgcgcgccgacgaatcgcctattcaacatctggcacgtttagcgccgcaggagctggaacaaaaactgcgtgactacctcggcggctttggtttccagggcgataaagtaaccgaagaaacgcgccgcttctccggtggggaaaaagcccgcctggtgctggcattaattgtctggcagcgtccgaatctgctgctgctcgacgaaccgaccaaccaccttgacctcgacatgcgtcaggcactcaccgaagcattaatcgagttcgaaggcgcgctggttgtcgtctcgcacgaccgtcatttgctgcgttccaccactgacgatctctacctggttcacgatcgtaaagtcgaaccgttcgacggcgatctggaagattatcaacagtggttgagcgacgtacaaaagcaggaaaaccagaccgacgaagcgccaaaagagaacgcgaacagcgcccaggcacgtaaagatcagaagcgtcgggaagcggagctgcgtgcgcaaacccagccactgcgtaaagagattgcccgtctggaaaaagagatggagaagctgaacgcgcaactggcgcaggcggaagagaaactcggcgacagcgaactgtacgatcaaagccgtaaagcggagttgaccgcctgcctgcaacagcaagccagcgccaaatccggcctggaagagtgcgaaatggcatggctggaagcccaggagcagcttgagcagatgctgctggaaggccaaagcaactgatggcgcagataacgacgaccgatgccaatgaattcagcagcagtgctgaattcacccccatgcgcggctttagcaattgtcatctacaaaccatgctgccgcgtctgttccgtcgcaaggtgaaattcaccccgtactggcagcggctggagttgcccgacggcgattttgtcgatctcgcgtggagtgaagatcctgcacaggcgcggcataaaccgcgtttagtggtatttcacgggctggaaggcagtctcaatagcccttacgctcacggtctggttgaggcggcgcaaaagcgcggctggctgggcgtggtgatgcattttcgcggatgcagcggtgaaccaaaccgtatgcaccgcatttaccattcgggcgaaaccgaagacgccagttggtttttacgctggctgcaacgcgagtttggtcatgcgccaacggctgccgtcggctattcgctcggcggtaatatgctggcctgtttgctggcaaaagaaggcaatgatctcccgattgatgcggcagtgattgtctctgcgccgtttatgctggaggcctgtagttaccatatggaaaagggcttttcccgcgtttatcagcgttacttgctgaacctgttaaaagccaatgccgcgcgcaagctggcagcctaccccggcacactgccgattaatctcgcgcagttaaaatcggtacgtcgcatccgtgaatttgacgatctcatcaccgccagaattcacggctacgctgacgctatcgactattatcgtcagtgtagcgccatgccgatgctcaatcggatagccaaaccgacactgattattcacgccaaagacgatccgtttatggatcatcaggtgatcccgaaaccggaaagtctccccccgcaggtggagtatcagctgactgaacatggcggtcatgttggctttattggcggtacattacttcatccgcaaatgtggctggagtcacgcattcctgactggttaacaacgtatctggaggcgaaatcatgttgattccgtggcaagacctctcccccgaaacgctggaaaatttaattgaaagctttgtgttacgtgaaggcaccgattatggtgaacatgagcgtacacttgaacagaaagtcgccgacgtcaaacgccagctacagtgcggagaagcggtgctggtatggtcggagctgcacgaaacggtcaatatcatgccgcgcagtcagtttcgcgaataacctgcaaccgtcggcggacgagataataatgatagctaagtcatggagttactatgtctgccaaacatccggtcattgcggtaacaggatccagcggcgcggggaccaccaccaccagcctcgcgtttcgtaaaatattcgcgcagttaaatctgcatgcagccgaggtggaaggcgacagttttcaccgttatacccgcccggaaatggacatggcgatccgcaaagcgcgcgacgccgggcggcatatcagctacttcggccccgaagcgaacgacttcggccttctggaacaaaccttcattgaatacggtcagagcggcaaagggaaatctcgcaaatatctgcatacctacgatgaagccgtaccgtggaatcaggtaccggggacattcaccccctggcaatctttaccggaacccactgatgtactgttttatgaaggtttacacggcggcgtagtcacgccacagcataacgttgcgcagcatgtggacttactggtcggcgtggtgcctatcgttaaccttgagtggattcaaaaactgatccgtgacaccagcgagcgcgggcactcacgagaagcagtgatggactcggtagtgcgttcaatggaagactatatcaactacatcacaccgcagttttcccgcacccatcttaacttccagcgcgttcccaccgtcgacacctcaaacccgttcgcggcaaaaggtatcccgtcgctggatgaaagctttgtggtgatccattttcgtaatctggaagggatcgatttcccctggctgctggcgatgttgcaaggctcattcatttcccacatcaatacgttagtggtgcctggcggcaaaatgggtctggcaatggaattaattatgctgccgctggtgcaacgattgatggaaggaaagaaaatcgagtaacgctgctattacgccggataaaatactatccggcttcacaacgggatagttaaatcacgcggcaaccacttcatacgagtgagtaatattcaccgctttttccagcatcagcgccactgaacaatatttctcggcagagagatcaaccgcacgcgcaaccgctgcgtctttcaggtcgcgaccggtgacgataaaatgcagattaatgtgcgtaaacaggcgtggtgcctcttcgcggcgctcagaggtcaattttacttcacaatcgaccacatcctgacgccctttttgcaggatagaaaccacatcgatggcactgcaaccacccgctgccatcaacaccatttccatcggacttggtgctttatcgcctgagttgccgtccattaaaatctggtgaccagaggcggattcgcccagaaaagttaacccttcgacccacttcactcgcgcttgcatttttgctactccactgcgtcaattttcctgacagagtacgcgtactaaccaaatcgcgcaacggaaggcgacctgggtcatgctgaagcgagacaccaggagacacaaagcgaaagctatgctaaaacagtcaggatgctacagtaatacattgatgtactgcatgtatgcaaaggacgtcacattaccgtgcagtacagttgatagccccttcccaggtagcgggaagcatatttcggcaatccagagacagcggcgttatctggctctggagaaagcttataacagaggataaccgcgcatggtgcttggcaaaccgcaaacagacccgactctcgaatggttcttgtctcattgccacattcataagtacccatccaagagcacgcttattcaccagggtgaaaaagcggaaacgctgtactacatcgttaaaggctctgtggcagtgctgatcaaagacgaagagggtaaagaaatgatcctctcctatctgaatcagggtgattttattggcgaactgggcctgtttgaagagggccaggaacgtagcgcatgggtacgtgcgaaaaccgcctgtgaagtggctgaaatttcgtacaaaaaatttcgccaattgattcaggtaaacccggacattctgatgcgtctgtctgcacagatggcgcgtcgtctgcaagtcacttcagagaaagtgggcaacctggcgttcctcgacgtgacgggccgcattgcacagactctgctgaatctggcaaaacaaccggatgctatgactcacccggacggtatgcaaatcaaaattacccgtcaggaaatcggtcagattgtcggctgttctcgtgaaaccgtgggacgcattctgaagatgctggaagatcagaacctgatctccgcacacggtaaaaccatcgtcgtttacggcactcgttaatcccgtcggagtggcgcgttacctggtagcgcgccattttgtttccccctatgtggcgcaggctgatttatcaccccgatatcaactatgcacttcgacaaacgctggtgctatgtttgcccgtggccgttgggttaatgcttggcgaattacgattcggtctgctcttctccctcgttcctgcttgttgcaatattgcgggccttgatacgcctcataaacgttttttcaaacgcttaatcattggtgcgtcgctgtttgccacctgtagcttgttgacacaggtgctactggcaaaagatgttcccctgccctttttgctgaccggattaacgctggtacttggcgtcactgctgagctggggccattgcacgcaaaattgcttcccgcatcgctgctcgccgccatttttaccctcagtctggcgggatacatgccggtctgggaaccgttgctcatctatgcgctgggcactttgtggtacggattgtttaactggttttggttctggatctggcgcgaacaaccgctacgcgagtcactaagtctgctgtaccgtgaactggcagattactgtgaagccaaatacagcctgcttacccagcacaccgaccctgaaaaagcgctgccgccgctgctggtgcgccagcaaaaagcggtcgatttaattacccagtgctatcagcaaatgcatatgctttccgcgcaaaataataccgattacaagcggatgctgcgtattttccaggaggcgctggatttgcaggaacatatttcggtcagtttgcatcagccggaagaggtgcaaaagctggtcgagcgtagccatgcggaagaagttatccgctggaatgcgcaaaccgtcgccgctcgcctgcgcgtgctggctgatgacattctttaccatcgcctgccaacgcgttttacgatggaaaagcaaattggcgcactggaaaaaatcgcccgccaacacccggataatccggttgggcaattctgctactggcatttcagccgcatcgctcgtgtgctgcgcacccaaaaaccgctctatgcccgtgacttactggccgataaacagcggcgaatgccattacttccggcgctgaaaagttatctgtcactaaagtctccagcgctacgcaatgccggacgactcagtgtgatgttaagcgttgccagcctgatgggcaccgcgctgcatctgccgaagtcgtactggatcctgatgacagtattgctggtgacgcaaaatggctatggcgcaacccgtctgaggattgtaaatcgctccgtgggaaccgtggtcgggttaatcattgcaggcgtgacgctacactttaaaattcccgaaggttacaccctgaccttgatgctgattaccaccctcgccagctacctgatattgcgcaaaaactacggctgggcgacggtcggttttactattaccgcagtgtataccctgcaactgttgtggctgaacggtgagcagtatatccttccgcgtcttatcgataccattattggttgtttaattgctttcggcggtactgtctggctgtggccgcagtggcagagcggattattgcgtaagaacgcccatgacgctttagaagcctatcaggacgcgattcgcttgattctgagcgaggacccgcaacctacgccactggcctggcagcgaatgcgggtgaatcaggcgcataacactctgtataactcattgaatcaggcgatgcaggaaccggcgtttaacagccattatctggcagatatgaaactgtgggtaacgcacagccagtttattgttgagcatattaatgccatgaccacgctggcgcgggaacaccgggcattgccaccggaactggcacaagagtatttacagtcttgtgaaatcgccattcagcgttgtcagcagcgactggagtatgacgaaccgggtagttctggcgatgccaatatcatggatgcgccggagatgcagccgcacgaaggcgcggcaggtacgctggagcagcatttacaacgggttattggtcatctgaacaccatgcacaccatttcgtcgatggcatggcggcagcgaccgcatcacgggatttggctgagtcgcaagttgcgggattcgaaggcgtaatacaggctaaaccatcggatgaggtgttcacgccgcatccgacatcttttgcctgacgcgtcttatttacgccccaatcaccttcgccaccgcgtgggcgaaacgatgcatcccttcatcgatatccgcatcttccaccaccagcgacggcgcaaaacgcatcacatcaggcccggcattcagcaccattacgccttcctctgcacccgcatacaggaaatcacgcgcccgacctttgtactgtggtttcagctctgcgccaatcaacagccccataccgcgaatatcgctaaacacatcgtactgctgatcgatcttctgcaaatggtcaacaaaacgctggcgtttcgcctgaataccttccagcacttcaggggtattgatgatatcaaacgctgcgcccgctactgcacaggccagaggattaccgccgtaggtggaaccgtgagaaccaggatgaaacgcggaagcaatctccgccgtggtcagcatggcgctaaccgggaagccgccacctagcgctttcgcagaggtcagaatatccggcgtcacgccgtagtgcatataagcaaacagatcgccgatccgccccatcccgcactgcacttcatcaaacaccaataatgcctgatgttgatcgcacagctcgcgcaagccctgcaaaaactctggcgtcgctgccgtcacgccgccctcgccctgaatcggctcaaccaccaccgcacaggtatggtcatccatcacggcttttactgcgtgaagctcgttaaaaggcacgtggatgatgtctgccggttttggcccaaagccgtcggaatattttggctgcccacccaccgaaacggtaaacagcgagcgaccatgaaaagcgttatggaaggcaataattttggttttgaacgggctatgacgcacacaggcgtaatggcgtgccagtttaaaggcggtttcgttagcttccgtgccggagttcataaacaccacgcgttcggcaaacgttgcctcaatcagtttacggccaagacgcagcgccggctcattggtgaaaacgttactaatatgccacagagtttcgccctgggtttttaacgcgttcaccagcgcaggatggcaatggcccaacgccgtaactgcaatgccacccgcgaaatcgacatactccttgccctgttgatcccagattcggctgccctgaccttttaccggaataaactctgccggagcataaatcggcagaatcacttcatcgaaagtcgcgcgtgtaattgctgtttgttcaattgccatctcatgatcaccctgttacgcataaataaatatgaaattataatcacaaaatatgcataaaaaatcactgaatggcaatcagaaatcagcgatgcagaaaattagccagcagttgatgtccttgttcgctaagaatactttctggatggaattgcacaccttccagatcccactggcgatggcgaatccccataatctcgcgggtttcgctccaggccgtcacttcaaagcactccggtaatgagtcaggttccaccaccagcgaatggtagcgtgtcacggtgagtggatttgccagccccttaaatacgcccacaccattatgtgtaatcggcgaggttttgccgtgcatgacctttgcggcgcgcacaactttgccgccaaatgcctgcgccattgcctgatgaccgaggcagacgccaagaatcggcaagcgtccggcatagtgacgaataacgtcaagggagatcccggcttcatctggcgtacaggggccgggtgagatgacaattttttgtggtttaagggcgtcgatatccgccaacgtcaacgcatcgttgcgcttaaccaacacatccgcccccagttcacaaaagtactggtagaggttccaggtaaaagaatcgtagttatcaataagcaggatcatggcggctccggtacgaaagaaccgcgctattttactcagattccccggcttcgcttaccactttgctaaatatcatctgcagcgcggtgagatcccccattgccccattctgatttgcctgattccaggcctctttttcgataccctgccagctcagttgatatccggcatgaatcgccagttgctcgaagaagatccgctgtgccaaaccacttcccacccggaagggatgcagcacgttgatttcacaatagtaatgcgccagccgctcgacgaacttcgctttctccaggccaaccagataaccttcttcctccagatcctgcatcagggcattgccctctttttcgatataagcaaagtggcagaacggcgtatcgccctgataaatatcgacttcgcgcagttgccccgcccagtcgaaaatatcctgatacagctggcgatggatagtgcgcaaatgcggtaaaccgcgcaccagcggaccgagctcaatggtcgcagcacgcagcgccgtcatttcgtaagcgacctgttccagccgctgctgctggcggatgttcagccggttacgcatgatatcaaggcctggataaagatacggatcgcgcccttcgccgaatttatcgctcatagtgcctcctcagcgcttcaaggcgcgctaaagcctctgcggcagtaagagtgactaaaggcatctcgacgccttcaagacggcgactggcctggaaattacgattacgctgaagctcccagagacgggacttttgcttatcggtgagtttcttcacttgatgcctccctgaacgtgtccatttgccacaagtataagcggcaaatccgggttacgccgggagagcagaagcgcgggcaagattgcccgcgcgagaaatcattacggcaggactttagcggaaaggataactaccggttttgacggcacattctggtacggaccaacgtcatgagtcggcacctgggaaatcttatcggcaacgtccatgcctttcaccactttaccaaataccgcgtaaccgaaatcacgctgaccgtggtcaaggaaggcgttatcggcaacgttgataaagaactggctggtggcgctgtctttgtcagcggtacgcgccatcgcgatggtgccacgcgtgttgcgcaggccgttatctgcttcatttttgattggcgggtttggttttttctgctgcatctgctcggtgaaaccaccgccctgaatcataaagccaggaatgacgcggtgaaaggtcgtgttgttataaaaaccactgttcacataatcgacaaagttttgcacagacactggcgctttttgtttatccagctccagttcgatgttaccagctgaggttgtcaacaatacgtgcgggtcccctttcgctgccattgctgcgggagaaagagcagaaagagcgaaaacagcagccatcgccgccagggtcgatttgaacatgagatttccttaacaaacagagcagaaaaaaagcaagtgaagagattctaaatagccttcaagaacaaggccatccctttacctaattttacgtatctgaaatatatgtaacctgaggataactttttattccgtgatcaaaatcacctcttaaaatgcaatttagcaaccgattgcaataaaacatttaatcagatcacaaaattgcctaaaatcgcccgctcgcggcatagcccgctatgccattttatttttgaacgcaggccaatcatgactaacagcaatcgcatcaagctcacatggattagctttctttcctacgcactgaccggtgcgttggttattgtcaccgggatggtgatgggaaatatcgccgattatttcaatctgcctgtttccagcatgagtaacaccttcaccttcctcaatgccggcattttaatctctatcttcctcaacgcctggctgatggaaatcgtcccgttgaaaacgcagttacgttttggctttctcctgatggtgctggcggttgccggtttgatgttcagccacagcctggcgctgttctcggcggcgatgttcattctcggggtggtcagcggcatcaccatgtcgattggtacattcctggtaacacaaatgtatgaaggacgtcagcgcggttcacgcctgttatttaccgactccttcttcagtatggccgggatgattttcccaatgatcgccgcgtttctgctggcacgtagcattgagtggtactgggtttatgcctgcatcgggctggtgtatgttgctatttttattctgaccttcggctgtgaattcccggcactgggcaaacatgcgccaaaaacagatgctccggtagagaaagaaaagtgggggatcggcgtactgtttctctctgttgcggcgctgtgctacatcctcggtcagttaggttttatctcctgggtgccggaatatgccaaaggcctgggcatgagcctgaacgacgcaggcacgctggtaagtaacttctggatgtcgtacatggtcggcatgtgggcgttcagctttattcttcgcttctttgatttgcaacgtatcctgaccgtactggctggtctggctgcgattctgatgtacgtctttaacaccggaacaccggcatatatggcgtggtcaattctcgccctgggcttcttctccagcgcgatctataccaccatcatcaccctgggttcacagcagaccaaagtaccgtcgccaaaactggttaactttgtcctgacctgcgggaccatcggtactatgttgacctttgtggttaccggcccgattgttgaacatagtggtccgcaggcggcgctgctgacggcaaacggtctgtacgctgtcgtctttgtgatgtgcttcctgttaggtttcgtcagccgtcaccgtcagcataacaccctgacctctcattaattgttcatgccgggcggcactatcgtcgtccggccttttcctctcttactctgctacgtacatctatttatataaatccgttcaatttgtctgttttttgcacaaacatgaaatatcagacaattccgtgacttaagaaaatttatacaaatcagcaatataccccttaaggagtatataaaggtgaatttgatttacatcaataagcggggttgctgaatcgttaaggtaggcggtaatagaaaagaaatcgaggcaaaaatgagcaaagtcagactcgcaattatcggtaacggtatggtcggccatcgctttatcgaagatcttcttgataaatctgatgcggccaactttgatattaccgttttctgtgaagaaccgcgcatcgcttatgaccgcgtacacctctcgtcttacttctctcaccacaccgccgaagagctgtcgctggtgcgcgaaggcttctacgagaaacacggcatcaaagttctggtcggcgaacgcgctatcaccatcaaccgtcaggagaaggtgattcactccagcgccggacgtaccgttttttatgacaagctgatcatggcgaccggttcctacccgtggatcccgccaattaaaggttctgatactcaggactgctttgtctatcgcaccattgaagacctcaacgccattgaatcctgcgctcgtcgcagcaagcgcggtgccgttgttggtggcggcctgttaggtctggaagctgctggcgcgctgaaaaacttaggcattgaaacccacgttatcgaatttgcccctatgctgatggcggaacagcttgatcagatgggcggcgagcagctgcgtcgcaaaatcgaaagtatgggcgtgcgcgttcacaccagcaaaaacactcttgagattgtgcaggaaggtgttgaagcgcgtaaaaccatgcgttttgccgacggcagcgaactggaagtcgactttatcgtcttctctaccggtatccgtccgcgcgataagctggcaacccagtgtggtctggacgttgctccgcgtgggggtatcgtcataaatgattcctgccagacttccgatccggatatctacgccatcggtgaatgcgcaagctggaacaaccgtgtatttggtctggtagcaccaggctacaaaatggcgcaggtcgccgttgaccatattcttggtagcgaaaacgcctttgaaggtgcagaccttagcgccaagctgaaactgctgggcgtagacgtaggcggtattggtgatgcgcacggtcgcacgcctggcgcacgtagctacgtttacctcgacgaaagcaaagagatctacaaacgcctgattgtcagcgaagacaacaaaaccctgctcggtgcggtactggtgggcgataccagcgactacggcaacctgctgcaactggtgctgaacgctatcgagctgccggaaaacccggattccctgatcctgccagcgcactcgggtagcggtaagccgtctatcggtgttgataaactgccggacagcgcgcaaatctgctcctgcttcgacgtcaccaaaggcgacctgattgctgctatcaacaaaggctgccacaccgttgcggcgctgaaagccgaaaccaaagccggtacgggctgcggcggttgtattccgctggtcactcaggtactgaacgcggaactggcgaaacagggtatcgaagttaacaacaacctgtgtgaacactttgcttattcgcgtcaggaactgttccatttgatccgcgttgaaggcattaaaaccttcgaagaactgctggcgaaacacggcaaaggttacggttgtgaagtttgtaaaccgaccgtcggttcgctgctggcctcctgctggaacgaatacattctgaagccggaacatactccgctgcaggattctaacgacaacttcctcgcgaacatccagaaagacggcacctactcggtgatcccgcgttctccgggcggtgaaatcaccccggaagggctgatggcagtgggtcgtatcgcgcgtgaatttaatctctacaccaaaatcaccggctctcagcgcctggcgatgtttggcgcacagaaagacgatctgccagagatctggcgtcaactgattgaagccggcttcgaaaccggtcatgcctatgcgaaagcactgcgtatggcgaaaacctgcgtgggaagcacctggtgccgctacggtgttggcgacagcgtcggcctcggcgtggaactggaaaaccgttacaaaggcatccgtacgccgcacaaaatgaagttcggtgtctccggctgtacccgtgaatgttcagaagctcagggtaaagacgtgggtattatcgccaccgaaaaaggctggaacctgtacgtttgcggtaacggcggcatgaaaccgcgtcatgcggatctgctggcagcggatatcgatcgcgaaacgctgatcaaatatctcgaccgcttcatgatgttctacatccgtactgccgacaaactgacgcgtaccgcgccgtggttagaaaacctcgaaggtggcatcgattacctgaaagcggtgatcattgacgacaaactggggctgaacgctcatctggaagaagagatggcgcgcctgcgggaagcggtagtgtgcgaatggactgaaacggtcaatacgccgtctgcgcagactcgcttcaaacacttcatcaacagcgacaagcgtgacccgaacgtgcagatggtgccagagcgcgaacagcaccgtccggcaacgccgtatgaacgtatcccggtaactctggtggaggacaacgcatgagccagtggaaagacatctgcaaaatcgatgacatcctgcctgaaaccggcgtctgcgcgctgttaggtgacgaacaagtagcaattttccgcccgtatcacagcgatcaggtgtttgcgatcagcaacatcgacccgttcttcgagtccagcgtgctgtcacgcgggttgattgcggaacaccagggcgagctgtgggtcgccagtccgctgaaaaagcagcgttttcgcttaagcgacggcttgtgcatggaagacgaacagttttccgtcaagcattacgacgcgcgagtgaaagacggcgtggtacagctgcgcggttaatattttaacgggaggcgcaatgcctcccctttttgcatggtcctgtaataaccttcggtatattgcaggacattttttaaactttttgttttattttttgtttttattttttaaaggataatcaaatgtttacagacactattactaagtgtgcggctaacgctgcgcgcattgcacgcctgtcggcaaataacccgctcggcttttgggtcagctccgccatggcgggcgcgtatgtgggtcttgggatcatcctgattttcacgctcggtaatttgctcgacccgtccgtacgtcctctggtgatgggcgcgacctttggtatcgccttaacgctggtgattatcgccggttctgaattgttcaccggacacaccatgttcctcacctttggggtgaaagcgggcaccatcagccacgggcaaatgtgggcaatcctgccgcaaacctggctgggtaacctggtcggttccgtcttcgttgccatgctttatagctggggcggcggtagcctgctgccggtagataccagcatcgttcactccgtcgcgctggctaaaaccaccgcaccggcaatggtattattcttcaaaggcgcattgtgtaactggctggtttgtctggctatctggatggcattgcgtacagaaggcgcggcgaaatttatcgcaatctggtggtgtctgctggcatttatcgcgtccggctacgagcactccatcgctaacatgacgctgttcgcactctcctggttcggcaaccacagcgaagcctacacgctggcgggcattggtcataacctgctgtgggtgacgctgggtaatactttatcgggtgccgtattcatgggattgggttattggtatgctacgccgaaagcgaatcgtccggttgcggacaaatttaatcaaactgaaacggctgccggttaattattaaggggtttttacgtggatcatttgcctatattttgccaattacgcgatcgcgactgtctgattgtcggcggtggtgatgtcgcggaacgcaaagcaaggttgctgttagacgcaggcgctcgcttaacggtgaatgcattagcgtttattccacagttcaccgcatgggcagatgcaggcatgttaaccctcgtcgaagggccatttgatgaaagccttctcgacacctgctggctggcgattgcagcgacggatgatgacgcgcttaaccagcgcgtcagcgaagccgctgaagctcgtcgcatcttctgtaacgtggtcgatgcgccgaaagccgccagctttattatgccgtcgattattgaccgctcaccgctcatggtagcggtatcctctggcggcacctctccggttctggcgcgcctgttgcgcgaaaaactcgaatcactgctgccgttacatctgggccaggtagcgaaatacgccgggcaattacgcgggcgagtaaaacagcagttcgccacgatgggtgagcgtcgccgtttctgggagaaattgttcgttaacgaccgcctggcgcagtcgctggccaacaacgatcagaaagccattactgaaaccaccgaacagttaatcaatgaaccgctcgaccatcgcggtgaagtggtgctggttggtgcaggtccgggcgatgccgggctgctgacactgaaaggtctgcaacaaattcagcaggcagatgtggtggtctacgaccgtctgatttctgacgatattatgaatctggtacgccgcgatgctgatcgcgttttcgtcggcaaacgcgcgggataccactgcgtaccgcaggaagagattaaccagatcttgctgcgggaagcgcaaaaaggtaaacgcgtggtgcgtctgaaaggcggcgatccgtttattttcgggcgtggcggagaagagctggaaacactgtgcaacgcgggtattccgttctcggtggttccgggtattaccgcagcttctggttgctctgcctattcgggtattccgctcacgcatcgcgattatgcccagagcgtacgcttaattaccggacacttaaaaaccggtggcgagctggactgggaaaacctggcggcagaaaaacagacgctggtgttctatatggggctgaatcaggctgcaactattcagcaaaagctgattgaatacggtatgcctggtgaaatgccggtggcaattgtcgaaaacggaacggcagtcacgcagcgcgtgattgacggtacgctcacgcagctgggcgaactggcgcagcaaatgaacagtccatcgctaattattattggtcgggttgttggcctgcgcgataaattgaactggttctctaaccattaatttaaccagggccagagaagtctggcctttttcgtttacaactctctttatatattcagcagataaaaacataaccccttaataaatattgtctgctaatgggttatattcaccgttacagcgacttacaaaattaagtcaatcgcttactgacgctaattgaatattcctgtatcgttcttaatgagcagtctgcttatattcatataatcaatgaatattaattaatatataatacatagggaatgtaaatgaacaaatttattaaagttgcactggtaggcgcagtactggctacgttaactgcatgtactggtcatattgaaaaccgtgataagaactgctcttacgactacctgctgcacccggctatttctatttctaaaatcattggcggttgcggtccgactgcacagtaagtctctgacagaaatcggctaacgccggtttaattgcctgatgccctcggagttatccgagggcgtatttgtttctgcattcttttcaaaaatatcgtttacaacgattaaatgctggcaatactttcacgcaagatccgcaatatcgtctcttcaccgctgcgatttgggttaatgcgaatcgcgcaatgttctaactgcggattcgcctggcgaaacgttccggaaagtcgataaaagagcggcgggatttcatattttgactctgcaccaaccgggtaaggcaaggcaccgagtttctgcgcctcttccagcactctggcggcaatcggctgatgaaactccacaatcaataccttcgactgtgcattggcaatgacggcgcttttcacttccgccaccgcgccgccgttaagcaaagccagcaaccgttcagatacccccgcctgcaccgcgtgcatcactggcgcgagcaccagaccacgcaacacctctaatgcctgcgccccctgaatctgactgccgccggaatagagcgtggcgcgaatccggctaataacatcggcatcgcctaccaccgcaccaacgccctctggcccaaatagcttgaagcaggaaaatgtcgacacattcgccccgcattcgcagccgattcgcgctaccttcatcaccgcatagttgtcatcggttaacgctggaacacctgccgcgcgcaacgttgccagcacgtctgccagcacatagcggtcctgcggctgctggcgcgtatgctgcaccagcgctgcatcaggttgttgctcgtcaacaacctgcttcagtgccgacagatcattgaaatcagccgtaatgagcgttagccccatctgctcaataataacccgtgtcgtcgggtaaacaggcgcgtcatgcaccagaagacgctgccccgatttgagcaaagccgccagtgccgcacggatcgcgccagtacccgcgccctgtaccagcgccgcggcctgtgcgtgaaacgcgtcagccagcacctgttccacacgctgggtaatgcggggctgatttagccccggcgttaagcccaaatcaccgcaggtaagaaactcgcagccaggaaaatgacggcaaatcgtgtccaccagcgcaaactgcttttgctgcgcctcaataagcgtcaggctttgcagaggaaacgtcttcataggtgccttccttaagccggaacgaacaggccaagccagtaaagaacattcagcaggatgccggtgatcattactgctacgaccggtgccgccattttctgtaccggacggcccagggattcgttgaggaagtaaatggcaaccgcgatagagaatccggtatagcccgccattttgattgctgcaaagatcgaaccgaccagcaacgccacttccatcagcatattcatggcgttacggatgttatccgacgcattacgtaccgacgggtagcgccccaaccatttgccgatcgaacgaagcagcaagacttccgccgaaataaccactgcgcctaataccgctgcaaccatcggattcggcgagagatagcccaccgcataaacaaaggtaaagcccgcaactgcatacacaccggtggctaacgccgtggtggcaatcaacggcacaaaacccagcccgcgcataaattctgccagtgccgcctggttgattagtgtttgcgattgttccggcgttacgcctgcggagtacgctttctccagtgtgaagatcgacacttcactaccggcgaaaatcttcatgctggcaacggcagcaatcaatgcacccacgatggcgatatacggtaagtttttgataatccgtgatgtacgctcttcaaacaccgacataccgctggcatcgatatcattttcatcacgatgacgcaggtcatgagttattgcgatccccagcagcatcaccatgccaataaagatttcgatggattcagggttaagatgtggggaatagcgcactaccaccacacgagtcatcagtaccaccacggcggcgatcagactttgcttccagccaaactggtagaaaatcgccaccaacgggaacagtgcaaaagctgaaaccaccggcgagcttaattcccccaggctacctaatacatccaccggtagcgcggtcagcagctggtttactggcaacagacaggtgaggatcaatattccccagatagcaccaagaccaaacgccatcaggctgtttatcgccagtacgccgaggatatcggtaggaagaaagagtaaccatgcgttgagcagcccggttttcagggtaaaagagatccccaccgaggccacaaaaccaatgctcagaccaaaagcgatactccccgcctcgcgacggttcatatagccttcaatcagttgcggcaggatcgggcggataccgtcatgaaaaacggctgccgagcgatgcgccagaagcgatgtcatacccgtcaggcacgccaccacgataatctgaatgtacagatccatagtcgtgccttttatttcagatggttaatcagcatcggaatcgcgtgttcgacgtgctcaacggaaaggccaaacgccacttttccttcagcgatcattttggcgatatgttcgtctttcgctttaatgcccggcttggcaatggtgcaacttttgttatagccaatcaccgcgatggcaatcgacaatgccgcgcccgcaccggtattacacgcgccgatgtagtaatccagttgtccggatttcactttcattgccgcttccatgtcgttgtgaatgaaaacttcaaaacagccaggagccgtcgcttcaatggtttttttaatctgctcacgctgtaagcctgcaacgccaatctttttcatgagtctgtccttattggaaaaattgagagggattttcacgtaacatcacatccacatcggcctgactgaatcctgactggcgcaattgcggaataaaggtggtcaataaaaagtcatagccataaccaccgttggcttttaaatgagagcgccgcgtaatatccatcgacagcatgacgcggttcagcaacccacggtcacgtagcgcatggagcatcgcaatgcgcttttcgtccgggtagtaactgttcttgccgatggtgtcgaactgcacatacgcgccgagatcgatcatcttcaaaatgttgtcgagattgtctttcagatcgcagtggccgacggtgacgcgcgaaagatcaactccgtgggcttgcaacagagccagttgctccagccccatcgtgctgaacgacgtatgcgtggagatcgggcgtccggtctggttatgtgccagcgcggcggcaataaacaccttctcttccagcggcgtaatcttcccttcgctggagccaatctccgcgatgatcccggctttcaggtcagtgccatcgataccctgctcaatttcatcgaccatctcctgcgccagttcctgcacgctgcgggtcgccacatgttccgggaaaaacgcgtcctggtaataaccggtacaggccaccacgttgatcccggtttcgcgcattacatcgagcataaattgcacattgcgccccatgtaacggttggtcatctcaatcacattacgcacgccccgggccatcaggtcgttcatctcctggcaaatgaacgcatactgatcaaggcggcagtccacgttgtttttaaagccggaaagatcaatatgcagatgctcatgggcaagggtgtagcccgtcggatcaaaactcatagggtgtctcctgcaaaccggaaggaggaaagaaaagagcgaccattttgtggcggtggcgcacggaaaaattcacacactgtagcccccacatcagaaagcgtggtgcgcacaccgagctgcgtagcgaccagtccttgctgataaaccagcactggcaccacttcgcgggtatggtggctgtgaccaatggtcggatcgttaccgtgatccgccatcacgaccaggcaatcatctggctgcatcgcctcaacaagccgggcaaggttacggtcaacgacctgcaaacgttcggcataacgtgcgacgtcttctgcatgaccagcgaggtcggtttcctggatattggtacaaataaacgccgtcggataggtgttaaattcgttgagggtgatatccataatccgctggctatccaccaggttttgccagctcacgccataaggattgctgacgatatctgccaccttacccaccagcacggttggcacgcccgcttcatacagtttttgcggcacctgcactttttcatcaacaccgtagcccatatgtacgacctggaaaccgttgtcataggcgccagaacgcggcgcattgatgccaataaagcgcccttctttgctttctgcggcatcgagaatgcgttgactgtcgggtaacaggccgccaaatgtaatgacccgaccgacctgtacctgctcacgcacaatacgacccattttgattgcgtcgtcaaaagagatcacagagagattggcggtgatgttatagacctggcctaaatccgcctcgagattatcgccaatcgcaaccgcctgattgacccacagaaattgcagatcatcgccacgacgctccacctgccaaccggcggatactaatgcctgctcaacacggtcaatcacatcacgaaagggcatccgcagcggcggtaatgggcgcgtacctaaaatctcctgatgccccataaaggtatcgccaccttcatgttgcagttccgccacgccccaggtggaggagtctgacggctgcatatcgccaggcgcataacccaatgcgttgattagccccagcgtctccagcgttggtagctgcaaatgcggcaactggctcaggatgtgaccacaggtattcgccccggcatcctgcggacgcaccaacgtgacatctttcattgcccctacgccaaagctatcaatcactaacaccacaaatcgcgccatttacgcctccagagggttgccgaggctgtcataacgaccaactatttctggttcgccacggtgaataccggacaccagcaccacatcgctacgggtgataaaaatctgcgtgcgaaaacagagcaccactgcactgcttaccggatgctcgcctgccagcggcagggtgtagtcgatactgctgtcatcaacggcgttgagatatgtttcagtaattctttgattttctggcgtaaacaccagcgcatgttgcgcgtgaccacgacggtagtaaccgccgccgtagcagtagctgtcgccacggaaatgatgggagatttcacttaaccagagcatcgcgatacgttcaggctgatcgccctgttgatttgccggaatagtacccgtcagcgcatgaccgggttcggtatgagtcacaccgtattccgccagcaatggcagcgacgtgcagctggtcgctgaaggcgcgttcagttgctcaatcgcaataccagatttcgccagttgatcccgtgcttgtaccagcgtgtgaagattcggtgtcggcaaaactttcccggcagcctcatcccaaagcaggcaagggaaatgggtaagtcccgccaaatgtagccccggcagattctggatttcagcaaccacctcgtgcagcgaatgctgtacaaaaccgctctcctgccccggataaagaaaatcatcgtcgctataaactttgagcagcacagactgcacacgtccggtcttcaccgctgccgcagaaatttcccgcgctttgtcgagggtaaacacagtgatgacgtcggttccctgttcaacggcgtcagaaacctgatgacaagggatttgtaccagatgcccctgatgcgctaccggcaaaccggcgcggcgcatgactcgcgcctctttgtaatccaccgccacaatgccgctgtagcccagagccagcagtttttctgccagccacggattacgaccgaattgtttggtcatcagatacagttcaatgccgtaaagccgcgccgtctcaatcagccgcttgccgttttccagaacttgatccacgtcgatcacccaactgtccggggcgatcttgccctgctgccacaaacttagtgcggcggaaatcagcgccggattctggcgtttcaatgcttctacaaacatcttgttgcctcgtttctgttccttgaattaaatattcatttttttgaatatttaggttgtacgacgtggatttatcgggagcttcaaacctcttcgttagcagccatccataatccataaaggttggccagcaaatagccttcttcacacgggttaacttccagtgcaaattccttcaacaatacctgatgcaattgcacaacggcttgccagtggctggattgcgccagttccgccagcaattcgtcatccagcggctctatttcttcaccacggcgactgcgcatcagtgcactcaccatatgtgtcatcgccatcgttccttgctcactgcgcaccggtagatggcactctgtttccagtacattgacgacctgcatcatgcctttgcagatgtccttatcaataacgcctgcatcgcaaagcaggttgagtctggtttccatatcagatgcctttcgtttaataactgggttcctgttccccactgactactcgctgttgatgagcaagcagggcatgtttatcaacaactgcacgcagcagttgttgcattgggtaatcatcggcacgcgtcaggatcacggcttcggtggcctgtaaaaatcgcggatcgtctgtgagcggcgtcgcttctaatcccagcatagtcagttcgttttccgccactacgttccagataaccgcgtcaacatcgcctttaacaatgcgttgtaaactctcgtgataagagagatcgactcgttccacatcactatcgccaaaaaagacatcggtcatgattttctgatctgccgaacggttatccagccccacgcgcttcacgtttgcggactcgcctttacggcaaatcaactggtgctcgccaacgtaggtatgcggtcccaactccagcgcgaggcataatcctttttgcgtgagataactttccgccgccagtcgcgaaaccaccgccatatcatacacgccgttaagtaaacactccacgcgaatatccgcgccgcgcatatgcgcatagtaaaaaggaatgccatcaaactgggctttcaatccgctcgccaggccttcgtacaaacgggtatagggcaagggcatcgcacataccacgttgttgatatccacatgagtcagcaatgctttgttatccatctcgaccagataactgccattgcgcccacggcgttcaatccgtatcgctccgcttgattccagcgttttcaacgcggcctgcgtcaggccaaccgatgaacggcattcagttgccagctcatctatggttttcagtcgattaccgcacttttcacccaacaaataacgggccagtgtcgtgataacgacgccttcttttttgataaacgttcgacgcataatatattttcaataaaatgaatgtttatatcttcaggaatttgaagataaggcgcaacagcgagatgtggaaacggcgaggcgcttcacattttttcggattattgcaaatgaggataaaaaaaccgggtttccccggtttttggcattaatgttaaattacggcttcgccacaaaaccaatcgcttcgtacaccgcttttagcgtacgggaagcgtgtgcgctggctttttctgcgccgtctttcatcacctgttgcaggaaggcttcatcgttgcggaaacggtggtaacgtccctgcaattcagtcagcataccggaaacggcatcagccacttcacctttcagatgaccatacatcttgccttcgaactgtttttccagttccgggatgctctggcccgttaccgcagaaaggatatccagcaggttggaaacgcccgctttgttctgcacatcgtagcgaactaccggcggctcgtcggagtcagtgaccgcgcgtttgattttcttcactaccgatttcggatcttccagcaggccgataacgttattgcggttatcgtcagacttggacatcttcttggtcggctccagcagcgacattacgcgcgcgccagatttcggaataaacggctctggcaccttaaagatatcgccgtacagcgcgttgaaacgctgggcgatatcgcggctcagttccaggtgctgtttctggtcttcacccaccggcaccagattagtttgatacagcaggatgtccgctgccatcagcaccggatagtcaaacagaccagcgttgatgttctcggcataacgcgcagatttatctttaaactgtgtcatacggctcagttcgccgaagtaggtatagcagttcaatgcccagcctaactgcgcatgttccggcacgtgggactgaacaaaaatggtgcttttctcaggatcgataccacaagccagatacaacgccagcgtatccagcgtcgctttacgcagcttctgtgcatcctggcgcacggtgatcgcgtgttggtcaacgatacagtaaatgcaatggtagtcatcctgcatgtttacccactgacgcagcgcacccatgtagttaccaatggtcaattcacctgagggctgtgcgccactaaaaacgatgggcttagtcatttttcgattcctgattttcgctatgcggaagccctaatgcgggcagaaggtcatttagagactgataaattacatcaggctggctgagatcgatagcctcgccgtagttatatccgtaggttaagccaactgatgggcaacctgccgcttttgctgcctgaatatcattgcgtgagtcgccaacaaacagcatctgttgtggagcaatgcccatccgttcagccaccagtaacagcggggccggatgcggttttttgttttgcacatcatcgccgccgataaccacgctgaagtatttggcgatatctaaggcttcgagcagcggcgcgacgaacggcgtcggtttgttggtgaccaggcctagcggcaggcctttagcctgcaacgcgcccaacgtatcggcaacgtgcgggaacaaaaacgtcccctcttcggcaacctcgccatagtagcgatcgaacagtttacgcagaatacgtacctgttcttctgccggaatgtcgtcatcaacgggcggtttacccattgttttacgcagagtcgcacgttcctgacgcgcccaggtcaatgcgcgctccatcagaatatctgcgccgttaccaatccaggtaataacgcgttcttcacctgcgacaggcaactccagcgcatacagcgccatatctaccgcagcagcaagaccgggggcactgtcaaccagcgtaccgtcgagatcaaaagcgacgccgcgaatatcttcaaacttattcatgacttacctttgccagttcactgcgcatttcatcaatgacttttttgtagtctggctggtcgaagattgccgaaccagcaacaaacatatccgcgcccgccgcagcgatttcgccaatgttgttcaccttcacgccaccgtccacttccagtcgaatgtcaaagccagactcgtcgatacgacgacgtacttcgcgcagtttatccagtgtttgaggaatgaaagactgaccgccgaaaccaggattgacggacatcagcaggatcacatccagcttatccatcacgtaatccagataactcagaggtgtcgccgggttaaataccaaacccgctttacagccattttctttaatcagttgcagcgtgcggtcaacatgctcggaggcttctggatgaaaggtaatgatgctggcaccagcggcagcgaaatcaggcacaatgcgatcgacgggtttcaccatcagatgtacgtcgataggggcggtaatgccgtagttacgcaaggatttcagcaccattggcccaatcgtcagattgggaacatagtggttatccatgacgtcaaaatgcacgacatcagcgccagctgccagggcttttgcggtatcttcacccaggcgggcaaaatcagccgacagaattgagggggcaatcaaatactgtttcatccgcttctccttgagaattattttttcgcgggtgaaacgactcctggtttgtacaaagccagcagttcgtccacctttttacgtgtgccgccgttgctgcttatactgcgtcgaactttgacgacatgcaattttgcgcgctgataccactcacgcgttaacatcgtatcgtgattggagatcagcaccggaatatggcgatcaaccagaccttcagcgatctccgccagatgcgcttgttgttcaagcgtaaaactgtttgtgtgatacgccgtaaagttggcagtcgcagacagcggcgcataaggcggatcgcaatagacgacagatgcatcatctgcgcgcgccatgctatcggcgtaagactcacaatagaaaaaggcattctgcgctttttcagcgaagtgatacaactctgcttccgggaaatagggttttttgtagcggccaaacggcacgttaaactcaccgcgcagattgtaacgacacaggccgttgtaaccgtagcggttcaaatataaaaacagtaccgcccgacggaacggatcctggcttttgttgaactcttcgcggaactgatagtaaacctcggcgcaatttgtttcgggaacaaacagctcgcgtgcggcctgtacgtactcatcagtacgcatcttcacaatgttatagagactgatcaggtcgctattgatatcggcaaggatataacgagaaaagtcggtgttgagaaacaccgacccggcacctacaaaaggctcaaccagacattcgcccttgggcaaatgccgtttaatatcatcaagcaggggatacttgccccctgcccacttcaaaaaagcgcgatttttcttcatgctgactaactaattacaccttctccggctgtggagaaagctccgacagcatccagcgcttcaggcaacgcccgcaatgataaaccattgcgggagataaccttgattacttcagatcggcctgtacctgacgcagcggtttcgcccacgggtttttggcctggacatctgctggcaatgtagataccgcttttttcgcctcttctttcgaagcatacacgccagaaaccaggacataccacggctgaccattacgcgtcgtttcatagacaacgtagtttttcagattctctttcttcgcccaaccgttcaggttgtcgtagttagaggaactgctcagctgcagagtgtaatggctggacggtgccgatttcaacgaaccaacattacctgcggtcttccctccagcggctggtgttgccgtggtttgcgccggggatgccgtctgtactggagccgtagtcgccgtctcttttggtgctggcgtagaagtcgcagccggtgcctttgtgctcgccacaggggcagctggttcagttcgcttcggcgtctgtgcgactggcttcggttccgttttcacggttgcttgcggttttttcggttcaatcaccgcctgctgacgagccgggcgcgtagtggccggacgttcagcggtttgcgttttcgccgtgtcacgcgatgcattgccattgcgaacaggcgcaaccgttgcgggttcagtcggcaatgtagaattgaccgccacattgttcaactgttgctgattttgtggctgggtcagcgcattgttcaggtcaccctgcacttcaacacgttgttgaccatccgttgccaccggggtttgcccttgagtcggcgtagaagagatcggcggcagagaaacatcctgctgagtattttccgcagacgtggttcccggcgctggctgcacgccattggcctgatcggtcgtattgcctgcaagatcaatactcttctcgccagacgcggtttgatcgctggaagaggtcgagggggcttttagcgcagaaccgataccgatgatcaacagcagtagaaccagaatgccgacacccatcatcatatactgacgagaagcgggtttactggctgcttttttgcgcttacgcggacgacgctctacgcgctcttcatccacggtttcatcttcggattcgtcaatttcttcttcgatttccggttcctcattacgcgctttttgcgcacgagtcggacggcgatcgtcagtgtcatcaagttcaatatcatcaaaattgatctgcggttcgccacgttcagtacgctcagaacgttcagaagattgacgagaacgaccagtacgacgatcgctgggatcgggtttcagctcgtcttctggtttgaattcatccatttaacaccccactaaaaggttaatgcttaccacgttgcaattaacctgaagctaatagaccgcttgataagcggcctgacctttcttgttgttacgctgattgacaatcggcaatggcgttaagaacaagctcgtgcgaaacgccgctgcgaacttcactcttaccaattgccaacggaagaattaagcgcatctctcccgcaaggactttcttgtcacgcagcatatgcggtaaatacgcctgcgcggacatttcgcgcggcccattgaccggtaacccagcccgcgtgagcagggttataatacgctgcgtttcggcagaactaaactgcccgagacgttccgacgtccgcgccgccatcaccatacccacagcgaccgcttcaccatgtaaccaattgccataccccatttcagcttcaatggcatgaccaaaggtgtgtcccagattcagtaaagcacgtaacccggtttcgcgctcgtcggcggcgacaacttctgctttcagctcacaacaacggcgaatacagtacgccattgccggaccgtccagacgcaacaacgcatccagattctcttccagccagttaaaaaacgcaccgtcaagaataatgccgtatttgatgacttctgccagccccgacgctaactcacgcgggggaagcgttttcagacagtcgagatccaccaccactgaagcgggctggtagaacgcgccaatcatgtttttaccgaggggatggttgaccgcagttttgccgccaacggaggaatcgacctgcgacagtaacgtcgtcgggacttgaatgaaacgtacaccgcgctgataactcgccgccgcgaagccggtcagatcacccactacgccgccgccaagcgccaccagagtagtatcgcgaccatgcggcttttgtaacaatgccgtaaagacggtatcgagtacagccaggcttttatactgctcgccgtcagggaggataacgctatcgacgttaacacccgcctgttcaagtacgccgcggaccttatcgagatacagaggagccagggtttcgttggtgaccaacatgacctgctcgcccgatttcagcggtaagaatgaagctggttcattaaacaaaccagatgcgatggtaattgggtaactacgttccccgagagtaacgacaatcctctccataacgcgacatccaccttaattactgtacccgcagacgagtgtatataaagccagaattagttgctttccagcatgtgaataatctggtttgcaaccactttagcgctttgatcatcagtacgaatggtcacgtcggcaatctcttcatacagcggattgcgttcattggccaacgcttccagaacttcacgcggcggtgtttcaacgtgcagcaacgggcgttttttatcacgctgcgtgcgtgcaagttgcttttcgatggtcgtttcaagataaacgacaacgccacgagcggaaagacggttacgcgtttcacgggatttcacagagccgccgccagtagccagcacaataccctgtttctcggtcaactcattgatgaccttttcttcgcgatcgcggaagccttcttcgccttctaaatcgaaaacccagcccacatcagctccggttcgtttctcaatctcttgatcggaatcgtaaaattccatattgagttgttgagctaactggcgcccaatagtgctttttccggcacccataggcccaaccagaaagatattgcgtttctctgccattttttcggtactactaagactattcgttaatgataaacccgcttcgctcagagagcgccgcaggacatgaactgaaacctcataagatattgcgagagtcagactgaaaattatctcaatactccagcgggtttggcaactgaataaatcacccatccctctgcatatctggtcgctgcaagcgcgctgccttgctaccaccgctctggcgataaatcaccgggtaagattagcgtaaaaaagacagcaaaatgccgcctgaatgataaatcatcatcatggaacgcaggcagcgaagagcaccaactctcaaatcggtactccttgtatgctaaatacctgcgcgcgtcaaatagatgaaacacgttcagcgtaaaaacattaccgcttttacggctgtttactcactggaaaccagtcgtggcgtgataaacaccactaactcgcgtcgttcatcttcttttccgtcatgatgaaataattgcccgaaccagggaatgtcgccaagcaacggtacgctatcctgacccgatttatttttacgggtaaaaatgccgcccagcgccaacgtttctccgcttttgacctcgacctgcgtttcgatctcctgcttatcaatcgccagcacttcgccatctgcctgctgtagcacctgccccggaacgttctggctgatgtgtaatttcagccggatgcgacctttttgtaacaccgtgggcgtgacttccatccccaggacggcctctttaaattccaccgacgtcgcgccactttccccgctggaaacctgatatggaatttcgctcccctgtttaatgctggcaggctgaagatgtgaggccagcagacgcggactggcgataatatccagctgctgtttttgttcgagcgcggaaagctcaagatccagtaaacgtccgttgatgcgtccaatgttaaaaccgatatgcgttgtcgccgtcgctacggagaggtcgctgccaagcgtggtgacttgcccaacgccaccagcttgttgcgcatcggccagcgtccatttcacacctaactcacgcaaacttttttcattaatggtgacaatatgcgccgagagctcaacctgcccgaccggcagatccatttgcgatacccactgttcaagcgtgcttaacgccgttttgttatctcgcagcaaaaggcgattggtgcgtttatcgacggtcatactccctttggcactcagtagcttctcccccgctttcgccagctctccggcgtcggcgtattgcagagtaatattgcgattttccagcggcagatttgcctgcgcccgcgtctgctccgcctcctggcgggcgatattgtcattctgccaggcaacggaatgcaccgagagaatgttgccctcctggcgcgttatcaatccggcgcttttcactacagtttgtagtgcctgcttccagggaacgtcagttaaatgtaacgacaccgtaccgctgacgtctggcgaaaccaccaggttcaacttctcctgttcagccagcacctgcaacacctgagctaccggaacgtcatccaccatcagcgtcactttttgcggctttgccgcctgtacgccgggtataagcatcaacagtagtgcggctatccattgcttcatttgtatctccttgccgttgccacaaccagtgtggcggttcgcagtttgtcccggttcccagcgttagtgcgtctggcgtcagctgtaagatcgtccagccgttttccagcacatcgttttgctgcacccgtcgccattttttttgcccatcttttattacaccgatgatgcgctcgcctctccctaccatcccctgatagcgccactggctaagttcgctaatccggcatagatcttccggcggtttaaaagggtcacgcataccggttaaaaggcacaatgcaatgcctgccaacaaccagcgtttaaccctcatgcggcgtctccagttgtagcgtgaacaaaaggtcatcaccttccacgcttaacaaaaaacggctcacgctgacgttgcgctctgccagccgtgtaaatgccgacggcactgcttcccacagcgttttcaacgccaactcacctccctgcgcggatggatgccagtaaaccagttgcgcgccggataactgaaaatccagtggcgaaaagggcagcgttttttcttcgctgaaggaagtggtgtctaccaggcgatacagtgcagcccactgctggtgatgatttgcccgtagtcgaattaatgcatcgctctcttcatggtgtgtcaatgacagaaaaatgagcgtaactaacaccagcaaccagactgcccagcaaaactggcggaggcggagtgatgtggcgaaccaccagtcaaagaacatgttcatcgctaaccttccttgttaactgatactcaaattgccagcgtccctgcgcatcctgctgcgtggccccccgctgattgagatgaaaagaagcatcctggcgtagtgacgtttctagtgcgtttaacgcggtaatgcttgttgtcagccccttgatctccagcgttccctgctgccagcttatcgttgtcagccaggcatgttcgggtaaaagcgccgccagtgcttccagcgcagattgccagtcgcgggtaaattgtcgctggcgctgacgttgcaaacgctgttcgcgtaactgctggcgttccagcaaacgtggtttcgttatctgtaagctgcgggcgagttgttgttccgcctgaagcaaaacggcgtttacgcgtgcttcggcattgcttgtcagacgcagtattagcgttatcccgacggccagcagcaaaggcgcaacgaacatcagcaaccagaaacgaagaaaagcggtccggcgttgctgtcgccagggcaaaaaattaattggcgggttcatcagtacaccttcccaagcgccagccccagcgcgatggcaaagtctccacctggtggcggtagcggcggctgacgaacagaaaccgcctcccaggggtcaaatccgccttcgccacatagcgcgacgctttcgggatcaacagataacgctgccgccagctccttcgcgctagtcatccccaccgccagtttgcgcccccagctatagcgcgtcgcccacagccactgttcgttatcacgccaggccagacattgctgatgagaaggtaaaaaaggtaggaatcgctgtaatgcactggcatccggagtgatcgcgctaacatgaacacgcaacctttctgccagagtaagcagcgttgccagctctttgctttgcgcggcagtcacgttataggcgggactgagtgcgtcttcgctgtaatcgaagcgcagggagtccggatccatatccagttcacgggccatcgtcccggacagccaggccatttgctcccgctcaccgagggacatcgacgggcgtggaaatgaccgctgtaatgtgcgactggcgggaaacgccaacataatgtgatgacgctgcggcagttcacgactccacggtaacaacgtgttagccagccgctgcacatcaacaatccgcccatctttgataatgtcgttctccagtggcaaccgccaccagcggtgcaataagcattcttttgcgctccgcacgatagcaaccgctaccgcttcttgctgttgtaaatgcaaaccaatttgccagttcttaaatgccattgtgatgatctccttatcacccgtcactctgacaggtatatcaatgcgtctggcttgcctttatactaccgcgcgtttgtttataaactgcccaaatgaaactaaatgggaaatttccagtgaagttcgtaaagtattttttgatccttgcagtctgttgcattctgctgggagcaggctcgatttatggcctataccgctacatcgagccacaactgccggatgtggcgacattaaaagatgttcgcctgcaaattccgatgcagatttacagcgccgatggcgagctgattgctcaatacggtgagaaacgtcgtattccggttacgttggatcaaatcccgccggagatggtgaaagcctttatcgcgacggaagatagccgcttctacgagcatcacggcgttgacccggtggggatcttccgtgcggcaagcgtggcgctgttctccggtcacgcgtcacaaggggcgagtactattacccagcagctggcgagaaacttcttcctcagtccagaacgcacgctgatgcgcaagattaaggaagtcttcctcgcgattcgcattgaacagttgctgacgaaagacgagatcctcgagctttatctgaacaagatttacctcggttaccgcgcctatggtgtcggtgctgcggcacaagtctatttcggtaaaacggtcgaccaactgacgttgaacgaaatggcggtgatagccgggctgccgaaagcgccttccaccttcaacccgctctactcaatggatcgtgccgtcgcgcggcgtaacgtcgtgctgtcacggatgctggatgaaggatatatcacccaacaacagttcgatcagacacgcactgaggcgattaacgctaactatcacgcgccggagattgctttctctgcgccatacctgagcgaaatggtgcgccaggagatgtataaccgttatggcgaaagtgcctatgaagacggttatcgcatttacaccaccatcacccgcaaagtgcagcaggccgcacagcaggcggtacgtaataacgtgctggactacgacatgcgccacggctatcgcggcccggcaaatgtgctgtggaaagtgggcgaatcggcgtgggacaacaacaaaattaccgatacgctgaaggcgctgccgacctatggtccgctgctgcctgccgcagtcaccagcgccaatcctcaggaagcaacggcgatgctggcagacgggtcgaccgtcgtattgagtatggaaggtgttcgctgggcgcgtccttaccgttcggatactcagcagggaccgacgccgcgtaaagtgaccgatgttctgcaaacgggtcagcaaatctgggttcgtcaagttgacgatgcatggtggctggcgcaagtgccggaagtgaactcggcgctggtgtcgatcaatccgcaaaacggtgccgttatggcgctggtcggtggctttgatttcaatcagagcaagtttaaccgcgccacccaggcactgcgtcaggtgggttccaacatcaaaccgttcctctacaccgcggcgatggataaaggtctaacgctggcaagtatgttgaacgatgtgccaatttcccgctgggatgcaggtgccggttctgactggcagccgaagaactcaccaccgcaatatgccggtccaattcgcttacgtcaggggctgggtcagtcgaaaaacgtggtgatggtacgcgcaatgcgggcgatgggcgtcgactacgctgcagaatatctgcaacgcttcggcttcccggcacaaaacattgtccacaccgaatcgctggcgctgggttcagcttccttcaccccaatgcaggtggcgcgcggctacgcggtcatggcgaacggcggcttcctggtggacccgtggtttatcagcaaaattgaaaacgatcagggcggcgtgattttcgaagcgaaaccgaaagtagcctgcccggaatgcgatattccggtgatttacggtgatacgcagaaatcgaacgtgctggaaaataacgatgttgaagatgtcgctatctcccgcgagcagcagaatgtttctgtaccaatgccgcagctggagcaggcaaatcaggcgttagtggcgaagactggcgcgcaggagtacgcaccgcacgtcatcaacacaccgctggcattcctgattaagagtgccttgaacaccaatatttttggtgaaccaggctggcagggtactggctggcgagcaggtcgtgatttacaacggcatgacataggcggaaaaacgggtaccactaacagttcgaaagatgcgtggttctcgggttacggtccgggcgttgtgacctcggtctggattggctttgatgatcaccgtcgtaatctcggtcatacaacggcttccggagcgattaaagatcagatctcaggttacgaaggcggtgccaagagtgcccagcctgcatgggacgcttatatgaaagccgttcttgaaggtgtgccggagcagccgctgacgccgccaccgggtattgtgacggtgaatatcgatcgcagcaccgggcaattagctaatggtggcaacagccgcgaagagtatttcatcgaaggtacgcagccgacacaacaggcggtgcacgaggtgggaacgaccattatcgataatggcgaggcacaggaattgttctgattaaaaaggcgcttcagcgcctttttaagtttgctgacaaagtgcactttgtttataccggatgcgggtgaacgcgttatccggccaacaaaaaattgaaaattcaataaattgcaggaacttcgtaagcctgataagcattatgcatcaggcaaacttcacgcatttacactcgcccctgccctttcaaccattcgcgcacgaggaacagcgcgctgacattacgcgcttcgttgaagtcaggggcttccagcaaatccatcatatgcgccagcggccagcgcacctgtggtaacggctctggctcatcgccttccagtgattccgggtagagatcttgcgctaccacgatattcattttgctggaaaagtaagacggtgccatgctgagcttcttcaaaaaagtcagatcgttcgcaccaaatccaacctcttcttttagctcgcggttagcggcttcaaagacgctttcacccggatcaattaatcctttcgaaaaacctaattcgtaggattcagttcccactgcgtattcgcggatcaggatcaggtgatcgtccacaatcggcacaatcatcactgcttcccggttggttggacgcattcgttcataaacacgccgcacgccattgctgaactccagatccacgctttcgacggtaaacagtcgggaacgggctacagtttcaacattcagaatggtgggtttttgtaatgatttgctcatcgtgggatctatgctgtgaaatcagcggttattgtgcgatatcggacacgctttcggcaatgtgaattgcgtgttatttacatttatgtaacttaataaataatcgtcctcaaatcaaattaaaagtcaataggttgaaataactccaggaatttgctgatattccgccctcagagggtttgctatgatcagcggttactgtgatgtgcttaatgatgctcaagttaaactccacgcttgccgatagccaaccgcagaatcatgtattgtgtccggtgcgactgaccacgcctgacagactaagtaagatggggaaagcatgagcaccattatgatttttttagctgctttgctggcctgctcactacttgcgggatggctgataaaagtgcgatccagacggcgtcagctgccctggaccaacgccttcgcggatgcgcaaacgcgtaaactcacatctgaagaacgtagcgccgttgaaaattatcttgagagcctgacgcaggtattacaggtgcctggcccaacgggagccagcgcggcaccgatctctctggcgctgaatgccgaaagcaacaacgtcatgatgctgacacacgctatcacgcgttatggcatctctaccgacgatccgaataaatggcgttactacctcgattcggtagaagtccacctgccgcctttctgggaacagtacatcaacgatgagaataccgttgaactgattcataccgattcgctgccgctggttatttcactcaacggtcatacgctgcaggagtacatgcaggaaattcgcggctatgccttgcaacctgttccgtcaacgcaggcgtcgattcgcggggaagagagcgagcaaatagaactgctcaatattcgcaaagaaacgcacgaagagtatgcgctgagtcgtccgcgcgggctgcgcgaagcgttgctgattgtcgcctccttcctgatgttctttttctgcctgattaccccggatgtctttgttccgtggctggcaggcggcgcgttactgctgctgggcgcaggtctgtgggggctattcgcgcccccggcaaaatcctccctgcgggaaattcattgtctgcgcggtacaccccgtcgttggggattgtttggcgaaaacgatcaggaacagatcaacaatatttcactcggtattatcgacctggtctatcccgcacactggcagccatacattgctcaggatcttggtcaacaaaccgatatcgatatctatctcgaccgccacgtagtgcgtcaggggcgatatctttcgctgcatgatgaagtaaaaaactttccgttacagcactggctgcgcagtacgattattgctgcgggctcgctattggtgctgtttatgctgttattctggatcccgctggatatgccgctgaaattcaccctctcgtggatgaaaggcgcgcagaccattgaaaccaccagcgtgaaacaactggctgacgctggcgtgcgggttggcgatacattgcgtattagcggtacgggaatgtgtaatattcgcacttccggtacctggagcgcgaaaaccaactcaccttttttaccgtttgactgctcgcagatcatctggaatgacgcccgctcattgccattaccagaatctgaattggtcaacaaagcgacggcattgaccgaagcagttaatcgccagctgcaccctaaaccggaagatgaatctcgcgtcagtgcctcattacgttcagcaattcaaaaatccggtatggtattgcttgatgattttggcgacattgttctgaagacagcagatctgtgttctgccaaagatgactgtgtgcgactgaaaaatgcgctggtcaatctcggcaacagtaaagactgggacgcgctggtaaaacgcgccaacgccgggaaactcgatggcgtgaatgtgttattacgcccggtgagtgcggaatcgctggataacctggtggccacctctaccgcgccgtttatcacgcatgaaacggcgcgagcggcacaatcactaaacagtccggcccccggcggattcctgattgtcagcgacgaaggcagcgattttgttgatcagccctggccttcggcatcactttacgactatccgccgcaagaacagtggaacgctttccagaaactggcacaaatgctgatgcatacgccgtttaacgccgaaggtatcgtcacaaaaatcttcactgacgccaatggtacgcagcatattggccttcatccgatcccggatcgttccggcctgtggcgctatctcagcaccacgctgctgctactgacgatgctgggtagcgccatttataatggcgtacaggcctggcgtcgttaccagcgccatcgtactcgcatgatgaagattcaggcctattatgaaagttgcctgaacccgcaactgatcaccccttcagaaagccttatcgaataacacgtttgcgcggcaggttatgctaccctgtcgcgcaaattgcttcactctggagatttccctcatgcatatcaacattgcctggcaggacgtagataccgttctgctggatatggacggcacgttgctcgacctcgccttcgataactatttctggcaaaagctggtgcctgaaacatggggcgcgaaaaacggagttacgccacaggaagcgatggaatatatgcgccagcaatatcacgacgtacagcatacgctaaactggtactgtcttgattactggagtgagcaactgggtctggatatctgtgcgatgaccaccgagatgggaccgcgtgccgtactgcgtgaagataccattccgtttcttgaggcactgaaagccagcggtaaacagcgaattttgctcaccaatgcgcatccgcacaacctggcggtaaaacttgagcataccggtctggacgcacaccttgatttattactttccacccacacatttggttatccgaaagaggatcagcggttatggcatgcggtggccgaagctacgggtcttaaagctgaaagaacgctgtttattgatgacagcgaagcgattctcgatgctgccgcgcaatttggtattcgttactgcctcggtgtgactaatcctgactccgggattgccgagaaacagtatcaacgccatccgtcactgaatgactaccgccgcctgatcccctcgctaatgtgaaggagatgccatgaaagaaaaacctgctgttgaggttcgactggataaatggctatgggctgcccgtttttataaaacccgcgcgctggcccgtgaaatgattgaaggcggtaaggtgcattacaacgggcagcgcagcaagccaagcaaaatcgtcgagctgaatgccacgctcactctgcgccagggaaatgacgaacgcacggtgattgtaaaggcgataactgaacagcgtcgccccgccagcgaggcagccttgctgtatgaagagactgcggaaagtgtagagaaacgcgaaaaaatggcgctggcacgtaaacttaatgccttaaccatgccgcatccggaccgacgcccggacaaaaaagagcgccgcgacctgttacgatttaaacacggcgacagtgaataactgtcacctgcaagagagatgattatgccgcaacatgaccaattacatcgctatctgtttgaaaactttgccgttcgcggcgaactggtaaccgtttcggaaaccctgcaacagatccttgagaatcacgattatccgcagcccgttaagaacgtgctggcagaactgctggttgcgaccagcctgttaaccgctacgttgaagtttgatggtgatatcaccgtacagctgcaaggcgacggtccgatgaatctggcggttattaacggtaacaacaaccagcagatgcgcggtgtggcgcgcgtgcagggcgaaattccagaaaatgccgacctgaaaacgctggtcggcaatggttacgtggtgatcaccatcaccccgagcgaaggcgaacgctatcagggcgtggttggtctggaaggtgataccctggcggcctgcctggaagattactttatgcgttctgaacagctgccgacgcgcctgtttattcgcaccggcgacgtagacggcaaaccggctgcaggcggaatgttgttgcaggtaatgcctgcgcaaaatgcccagcaggacgactttgaccacctggcgacgctaaccgaaaccatcaaaaccgaagaactgctgactttaccggcaaacgaagtgttgtggcgtttgtatcacgaagaagaggtgacggtttacgatccgcaggatgtggagttcaaatgcacctgctcgcgtgaacgttgcgccgatgcgctgaaaacgctgcctgatgaagaagtcgatagcatcctggcggaagatggcgaaattgacatgcattgtgattactgcggtaaccactatctgttcaatgcgatggatattgccgagatccgcaacaacgcgtctccggcagatccgcaagttcattaatgagtatgtccggcagagaggactctgccggattttacgactaatacacctgatgcgctttgtcactcattcagattcacatccagcctttcaccatccactacaagatcgcgccacgctttaggcctcgtccccagctttccatccttcgcagctgtgagtaatttttctttcgttattttgcgcggaagtaaactcatatcaagcgcgtcccattcttttctggttgagtcaaagccatagacaatgactctgtcatcattaaaagcaaacaggatccgctccgcctgaccatcactattcagatcttgctcgaccagtacgcaggcgtcttttccaatacaggtcatcacgttatagcgatcctggattaaggccgaccagaatgtcgcatccggtttaccagaacctggggcaattaacacattatcggctaatactttttccgatacctgttcctgaagatgttgctctccatctaacgccatcagcagatcccgcgcgcgtttcgggtctttcatatactcggcatcgcttttcagcgactcaagcgccgcacgtccatagcgaccgctctgttcgagcatgtagatagttacctggtctggcgtgtttttgccgctctgataacgcgccatatgactgttcacgctaatgcgcatactgtccagcaccggcgaattaagaagcaccagtattaccaacaccaataacgaaaccacaaggttcactttgccctgaagatcaaggggattttgccctttacgccagacgatactgacaaaataccccagcgaccataccagtaacaccagcaccgccagcgcgccctgcaagcggtcggcagtccagccgtactgagcgacccgcagccatagcgcccaggcggcggcgaacacatacagcggagcaaccagcaaagcggttttaatcaggcaacgcaatggccccgtccagggaagtgacgctttttgcggatcgcggacaatagccattaagatcaattgcaaaaaggccagcgttaacagcaacccagcggcggagatgtggcgagaaatcgcgctcaggcccgtaaacggcagggtgataataaacatcagggttagcaatgatactaacggcagcaaccccgtggcgattaacgtgaacaacttttgaatagagtcgattaaacgtgactgtgttcgcgcgaggatcaccgccagtgcggtaaccagacctaacgtgagataaataaacccgtcggttgcaaaaaagagcgttttgaaaaacgtgatgccaacaagtttaaacaactctccccacagtaaaagtaccagccacgtcaggccattggcgagaaaaatcaccagtaatataagtaagttatgccatactgactggtaaaagtagcgatagcggctactgtcattgcggatgcgaaggctttgttgtatccacggtagcaacaacattgccatcagcagcagatagcagccaaaatcccaaagcgccttttctgctctccagtggttcatgccatcaatttgccactttagccaaccgctcattcccagcgtggcaataaacaccagcgccagccatccccaaaggcgcttctgtttaaaggagatcacggagaagagtaaaacggatgaaaacgcgacggtcgcaggcacgccataaacaatccaactgtgattttttccggcaagccaggcgatcagcaggtagcaaaccagcccctgaagtaatccggtagcaatcatcccccagcgtgttgccggtgaaagttcaacgttatccatgttggttatccagaatcaaaaggtgggttaattatcgcatccgggcagtagtattttgcttttttcagaaaataatcaaaaaaagttagcgtggtgaatcgatactttaccgattgaatttgcatcaatttcattcatgaatgcgattccactcacaatattcccgccatataaaccaagttttaaccttttgagaacattttccacacctaaaatgctatttctgcgataatagcaaccgtttcgtgacaggaatcacggagttttttgtcaaatatgaatttctccagatacgtaaatctatgagccttgtcgcggttaacacccccaaaaagactttactattcaggcaatacatattggctaaggagcagtgaaatgcgcgttaacaatggtttgaccccgcaagaactcgaggcttatggtatcagtgacgtacatgatatcgtttacaacccaagctacgatctgctgtatcaggaagagctggacccgagcctgaccggttatgagcgcggggtgttaactaatctgggtgccgttgccgtcgataccgggatcttcaccggtcgttcaccaaaagataagtatatcgttcgtgacgataccactcgcgatactttctggtgggcagacaaaggcaaaggtaagaacgacaacaaacctctctctccggaaacctggcagcatctgaaaggcctggtgaccaaacagctttccggcaaacgtctgttcgttgtcgacgccttctgtggtgcgaacccggatactcgtctttccgtccgtttcatcaccgaagtggcctggcaggcgcattttgtcaaaaacatgtttattcgcccgagcgatgaagagctggcaggtttcaaaccagactttatcgttatgaacggcgcgaagtgcactaacccgcagtggaaagaacagggtctgaactccgaaaacttcgtggcgtttaacctgaccgagcgcatgcagctgattggcggcacctggtacggcggcgaaatgaagaaagggatgttctcaatgatgaactacctgctgccgctgaaaggtatcgcttctatgcactgctccgccaacgttggcgagaaaggcgatgttgcggtgttcttcggcctttccggcaccggtaaaaccaccctttccaccgacccgaaacgtcgcctgattggcgatgacgagcacggctgggacgatgacggcgtgtttaactttgaaggcggctgctacgcaaaaactatcaagctgtcgaaagaagcggaacctgaaatctacaacgctatccgtcgtgatgcgctgctggaaaacgtcaccgtgcgtgaagatggcactatcgactttgatgatggttcaaaaaccgagaacacccgcgtttcttatccgatctatcacatcgaaaacatcgttaagccggtgtccaaagcgggccacgcaactaaagttatcttcctgaccgcagacgcctttggtgtgctgccgccggtttctcgtctgactgccgatcaaacccagtaccacttcctctctggcttcaccgccaaactggctggtacagagcgcggcatcaccgaaccgacgccaactttctccgcctgcttcggcgcggcattcctgtcgctgcacccgactcagtacgcagaagtgctggtgaaacgtatgcaggcggcaggcgcgcaggcgtatctggttaacaccggctggaacggcactggcaaacgtatctccattaaagatacccgcgccattatcgacgccatcctcaacggttcgctggataacgcagaaaccttcactctgccgatgtttaacctggcgatcccaaccgaactgccgggcgtagacacgaagattctcgatccgcgtaacacctacgcttctccggaacagtggcaggaaaaagccgaaacgctggcaaaactgtttatcgacaacttcgataaatacaccgacaccccagcgggtgccgcgctggtagcggctggtccgaagctgtaatgatttgaagctggagaatatctatccagtatcttatagaaagcaaaacgggaggcaccttcgcctcccgttttatttacccttcttttgtcgcaccctgcgcccgcgttaccggcactggcagccaggcgcgaatggaaagcccgccccgttcgctggtgccaagctccagcatcccgttatggttatccacgatacgctgcacaatcgccagccctaatcccgtgccgctaatagtgcgcgcactgtcgccacgaacaaacggctggaacaggtgcttacgttgttccggcgcaatacccggaccgtcatcttctacctggaaccaggcgcgattcggctccgtgccgctgctgactttgatccagccattgccgtaacgggcggcgttgaccaccatattcgccaccgcgcgtttgatcgacagcgggtgcattttcacctcaatgctgccggggtaaagcgcggtttcaatttcccgctcatagccactttcggcggcaatcacctcaccgagcacggcgttgagatccgccatttccatcggcatctcctgcccggtgcgcaggtagtcgataaactgctcaatgatggcgttgcactcttcgatatctttattgatcgattctgccaggtagccatcctgctcgctcatcatctcggttgccaggcgaatacgcgtcagcggcgtgcgcagatcatggcttacccccgccatcagcagcgtgcggtcatccgccagttgcttaacaccagccgccatatgattaaaggcgcgggtaacggaacgcacctccgaagcgccatattcacgcagcggcggcggaataatccctttacccacctgcaaggctgcgtgttcgagatcgaccaacggtcggttctggatacgaataaacagccacgccccgcctatcgccaatagcataatcgccaacgtataacggaacagcggggagaaatcgccctgatgaatttcggttagcggcacgcgtacccagatattgggcgacaaccaggttttcagccagacgacaggcgaacttttgttgacctcgacgcgaacttccgtcggaccgcccagttgctgcgccatctgatggcttaagaattcatagtgttgcgcccaacgcagacctgcctcttcggcagcttcgttggaatagagagagatccccagctcacggtagatctcccgacggaaagcgggaggcacaaccaactgcgtgccgtcctccagttgcagtttgtcggtcatcaacatacgcacttcgtacgcgaggactttattaaactgctggaggctcggcaaaatcgcgaagttcagcaccaccagataagtcgtcaccaggctgacgaacagcaaggtgacgatgagcaataacgtacgggcaaatgaacttcgtggcgagaagcgcaatcgcctcatgctttagaaccgtccggtacaaagacgtagcccagaccccagacggtctgaatgtaacgcggatgcgccggatcttcttccaccatgcggcgcagacgcgaaatctgcacgtcgatggagcgttccattgcggaatattcacgaccacgggcaaggttcatcagcttatcgcgggagagcggctcacgcggatggctgaccagcgccttaagtaccgcaaactcaccactggtgagcggcatcggctcgtcttcgcggaacatttcgcgcgtaccgaggttaagtttgaacttaccgaaagcaattaccgcctcttcctgtgacggtgcgcctggcagttcattcgcctgacgacgcagcaccgcacgaatgcgggccagcagttcacgcgggttaaacggttttggaatgtaatcgtcagcgccaatctccaggccaacgatacggtccacttcttcccctttcgccgtcaccataatgatcggcatcggattgctctggctacgaagacgtcggcaaatcgacaagccatcttcaccaggtaacatcaaatccagtaccataagatggaaagattcacgagtcagcaggcgatccatctgttctgcattagcgacgcttcgaacctggaagccttgttcggtgagataacgttccagcagcgcgcgcaggcgcatgtcgtcatcaaccaccagaatcttgtagttctcttgcattgtttgtactcccaaaggttcgcaacaatttgtaagcgtgtattcttaaaaaagctcacgttcgtcaccagctaaatctggtatgaatttcagcctaaattgttacaaagcatattaaacagcagcttaagtatacaatttattcggcgaaacattattgattctgttgatatgatcacgttatacccaatgtgcgcattatcaaacagacaaagggaatcaacgagatgaaaacgcccctggttacccgggaagggtatgaaaaactcaaacaagagcttaattatctctggcgtgaagaacgcccggaggtcacaaagaaagtgacctgggccgcaagtctgggcgaccgcagcgaaaatgctgactatcagtataataaaaagcgcctgcgtgaaatcgaccgtcgcgtgcgctatctcactaaatgcatggaaaatctcaaaatcgtcgattactccccgcagcaggaaggcaaagtcttttttggcgcgtgggtggagattgaaaacgacgatggtgtgactcaccgtttccgtattgtcggctacgatgaaatttttggccgtaaagattacatctctatcgattccccgatggcccgcgcattgctgaaaaaagaagtcggcgatctggcggtggtgaatacccctgccggggaagcgagctggtatgttaatgctatcgagtacgtgaaaccgtaaggaagagtcttaacctcctgccgatggctggcatttttgccagccagtccgtataactatcccctgatttttgatccgaaaagatgaactcaaaccatgatgaatgattcgttctgccgcattattgcgggtgaaattcaggcgcgcccggaacaggttgacgctgccgttcgcctgcttgacgaagggaataccgtgccgtttatcgcacgttatcgtaaggaaatcaccggcggtctggatgacacgcagctgcgtaatctggaaacgcgtctgagctatctgcgcgagctggaagagagacgtcaggcgatcctcaagtccatttccgagcaaggcaaactcaccgatgatctggcgaatgccatcaacgccaccctaagcaaaaccgaactcgaagacctctacctgccctacaaacctaaacgccgcacccgtgggcaaatcgccattgaagcagggcttgagccgttggccgatctgctgtggagcgatccgtcacacacgccagaagtcgccgctgcacaatatattgatgccgataaaggcgtggcagataccaaagccgcgctggacggcgcgcgctatatcctgatggaacgttttgccgaagatgctgcgctgctggcgaaagtgcgtgattatctgtggaagaacgcgcatctggtctcaaccgtggtgagcggtaaagaagaggaaggggcaaaattccgcgactatttcgatcatcacgaaccactgtcaacggtgccttctcaccgcgcactggcgatgttacgtggtcgtaacgaaggcatacttcagctttcgctgaatgccgatccgcagttcgaagagccgccgaaagagagctattgcgagcaaatcatcatggatcaccttggcctgcgcctgaacaatgctccggcggatagctggcgcaaaggtgtggtgagctggacgtggcgcatcaaggtgttgatgcatctggaaactgaactgatgggcaccgtgcgcgaacgcgcggaagatgaagcaatcaacgtctttgcccgtaacctgcacgatctgctgatggcggcccctgccggactgcgtgcaacgatgggcctcgatccgggtctgcgtaccggggtaaaagtggcggtagtcgatgcgacaggtaaactggtggcgaccgataccatttatccgcataccgggcaggccgcaaaagcagcgatgaccgttgctgtgctgtgtgaaaagcataacgttgaactggtggcgatcggcaacggtacagcttctcgcgaaaccgaacgtttctatctcgacgtgcagaagcagttcccgaaagtgaccgcgcagaaagtgatcgtcagcgaagctggcgcgtcggtttactcggcttccgagctggcagcacaggaattcccggatctcgacgtttcgctgcgtggcgcggtgtctatcgcccgtcgtttgcaggatccgctggcggagctggtgaaaatcgatccgaaatctatcggcgtaggtcagtatcagcatgacgtcagccagacgcagctggcacgcaaactggatgcagtagtagaagactgcgtaaacgccgttggcgtcgatctcaacaccgcttctgttcctctgttaacccgcgtggcgggcctgacgcgcatgatggcgcaaaacatcgtggcctggcgcgatgagaacggccagttccagaaccgtcagcaactgttaaaagtgagccgtctggggccgaaagccttcgagcagtgcgcgggcttcttgcgcattaaccacggtgataacccgctggacgcttctaccgttcacccggaagcctatccggtggtggaacgcattctggcagcaacacagcaggcactgaaagatctgatgggtaacagcagcgaactgcgtaacctgaaagcgtctgactttactgatgagaaattcggtgtgccgacggtaaccgacatcatcaaagagctggaaaaaccgggtcgcgatccgcgtccggaatttaaaaccgctcagtttgccgatggcgtcgagacaatgaacgacctgcaaccgggtatgatcctcgaaggtgcggtgaccaacgtcaccaactttggcgcgtttgtcgatattggcgtgcatcaggacggcctggttcacatctcttcattgtcgaacaagtttgtggaagatccgcataccgtggtgaaagcgggcgacattgtgaaggtgaaagtgctggaagtggatcttcagcgtaaacgtatcgccctgaccatgcgtctggacgagcagcctggcgaaaccaacgcccgtcgcggtggcggtaatgaacgcccgcaaaacaaccgcccggcagccaaaccgcgtgggcgtgaagcgcagcctgccggtaacagcgcgatgatggatgcgctggcggcggcaatgggtaaaaagcgttaaaccccctgattggcctacggttcaaattttcacgaaatcgtaggccagataaggcgttcacgccgcatctggcaatacacgccttgcctgacataaaaatgccggagtatatctccggcatttttattccacagccaaccccacaatatactccctaatatttatcaattcattaacaactgagaccttaattaaacattaaccagccctaataattcgtcatgcgaattatattttcgctgcgatataaccttgagccatatcaacattgagtcagattattattcaaaccaacattcacacacattttaagtattgctgatagaaaccattctcattatcattgtactgttgattatttaatctctccttcgttggcaaatcatctggtctcatgtcgctgtcaaacgccccatgaggtagttatccagttaatgagaaacaagtaggcacctatgcaatacactccagatactgcgtggaaaattactggcttttcccgtgaaatcagcccggcatatcgccaaaaactgctttctcttggcatgttacctggctcctcttttaatgtggtacgcgtcgctccactcggcgaccccattcatatcgaaacccgtcgtgtgagcctggtattacgcaaaaaagatctggccttattagaagtggaagcggtttcctgttaatacggtgataacaacaatgaaaaaattaaccattggcttaattggtaatccaaattctggcaagacaacgttatttaaccagctcactggctcacgtcagcgtgtaggtaactgggctggcgttaccgtcgaacgtaaagaagggcaattctccaccaccgatcatcaggtcacgctggtggacctgcccggcacctattctctgaccaccatctcatcgcagacctcgctcgatgagcaaatcgcctgtcactacattttgagtggcgacgcagacctgctgattaacgtggtggatgcgtctaaccttgagcgtaacctgtacctgacgctgcaactgttggaactcggcattccatgcatcgtggcgctgaacatgctcgacattgccgagaagcaaaatattcgcattgaaattgatgctctgtcggcgcgtcttggctgcccggtgatcccgctggtttcaacccgtggtcgcggtattgaagcgctcaagctggcgattgatcgctataaagctaacgaaaatgtggaactggtgcattacgctcagccgctgctcaacgaagcagattcactggcaaaagtgatgccttccgacatcccgctgaaacaacgtcgctggctgggcctgcaaatgctggaaggcgatatctacagccgcgcctacgccggtgaagcgtcgcagcatctggatgctgccctcgcccgtctgcgtaatgagatggacgatccggcgctgcacattgccgatgcgcgttaccagtgcattgctgccatctgtgatgtggtaagcaacaccctgacggcagaacccagccgtttcaccactgcggtagataaaatcgtgctcaaccgtttcctcggtctgccgattttcctctttgtgatgtacctgatgttcttgctggctatcaacatcggcggggcgttacagccgctgtttgacgtcggctccgtagcactatttgtgcatggtattcagtggattggctacacgctccacttcccggactggctgactatcttcctcgcccaaggcctgggcggtggtattaacaccgtgctgccactggtgccgcagatcggcatgatgtacctgttcctctccttccttgaggactccggctatatggcgcgtgcggcgtttgtgatggaccgtctgatgcaggcgctgggcttgccggggaaatcctttgtaccgctgatcgttggtttcggttgtaacgtaccgtcggtaatgggcgcacgtacgcttgatgcaccgcgtgaacgtctgatgaccatcatgatggcaccgtttatgtcctgcggcgcgcgtctggctatcttcgcagtattcgcggctgccttcttcgggcagaacggtgcgctggcggtcttctcgctgtatatgctgggtatcgtaatggcggtgctgacgggcctgatgctcaagtacaccatcatgcgcggtgaagcgacgccgtttgtcatggagctgccggtctaccatgtaccacacgttaaaagcctggttatccagacttggcagcgtctgaaaggcttcgttctgcgtgctggtaaagtgattatcattgtcagcattttcctgagcgccttcaacagcttctcgctgagcggaaaaatcgtcgataacatcaacgactcggcgctggcttccgtcagccgggtgatcaccccggtcttcaagccgattggcgtacatgaagataactggcaggcaacggttggcctgtttacaggtgccatggcgaaagaagtggtggtgggtacgctcaacaccctctacaccgcagaaaatattcaggacgaagagttcaatccggcggaatttaacctcggtgaagagctgttcagtgcggtagatgaaacctggcagagcctgaaagacaccttcagccttagcgtactgatgaaccccattgaagccagcaaaggcgacggcgaaatgggtaccggggcgatgggcgtgatggatcagaaattcggtagcgcagctgccgcatacagctacctgattttcgtcctgctgtacgtaccgtgcatctcggtgatgggggctatcgcgcgtgaatcaagccgtggctggatgggcttctccatcctgtgggggctgaatattgcttactcactggcaacattgttctatcaggtcgccagctacagccagcatccaacttacagcctggtgtgcattctggcagttatcctgtttaacatcgtggttatcggtctgctgcgccgcgcgcgtagccgggtagatgtcgaactgctggcaacgcgcaaatcggtaagcagttgctgtgcggccagcaccactggcgattgccactaaggacacgacaatggcttcgctcattcaagtgcgtgatttactggcattacggggccgtatggaagcggcccagattagccagacactgaacactccgcagccaatgattaacgccatgctgaaacagctagaaagtatgggaaaagcagtgcggattcaggaagaacctgacggctgtctttccggcagttgtaaaagctgcccggaaggaaaagcctgtctgcacgaatggtgggcgttgcgttaaccttgtttcactgcctgttttgaaagcccggtatgcgtttgcatccgggcttttttgcgtgcggctttccataaaaatgcaacccttgcagcgcgacgtaagttcctctgaaagcgtctcgcagggatgaaaactcgctaatgcacaggtgtggagtggcgcgtagagtcgcggcattcaaataacaggtgaaggaacgccatgagcaaaaagcagagttccaccccacacgatgcgttacgccattgccgcaatgcaaaatcaccttgatgccggatacaaaacattgccgatggtggtgccattgttgttttatcacggtattgaaagcccctatccctattcgctgtgttggctggattgtttcgccgatcccaacctggcaaggcagctttatgcctctgcatttccgctgattgatgtcaccctcatgcctgatgatgaaatcatgctgcaccgacgtatggcgctactggagttaattcaaaaacatattcgtcaacgcgacctgatggggctggtagagcaaatggcctgcttattaagtagtggatacgctaatggcagacaaatcaaagggctgtttaattacatactgcaaaccggcgacgcggtacgttttaacgattttatcgatggtgtggccgaacgttcaccaaaacacaaggagagtttaatgactattgcggaaagattgcggcaggaaggggaacaatccaaagccttgcatatagcaaaaataatgcttgaatccggagtccctcttgcagacatcatgcgctttaccggggtgtcagaagaagagttggctgcggcgagccagtaaagttctgtcccgccatttcgaaagccacctacaccctctgcttcaacgccaccagcagatgacaaaactcgtccggatgtgaaataaacggcgcatgggccgctttggcgaagatatatgattcgctgtgaggccaaagtttatccagcatcggcaccactttgcgcggcaccagaccgtcgagatagccatacaatcgcaaaaacggcatgggcacgttttgcagcggctgacggagatcgaccgttttcaggatttccagcccgccattaagcacgtcaacctccggcatcggtaacgccagaacggttttcttcaacgcccgcgcatcctggcgcgccgtttcagtacccatggtttgtaacgccaggaaccgctccactgtacgctgaaaatcatcactgagttgctgctgaaatcccgccagcacgtccggttttatccccggccactcgtcgcgagcactaaaacaaggtgacgacgccacggtgaccagcgcctgaacccgctcgggatgggttaacgcaatctggcttgccaccagcccgcccagactccagcctaaccaaatggctttatctggtgcctgtcgcagcacgacttcggccatatcagcaagtgatagcgcaccaaatccccggctacgcccgaagccgggcaggtcaacaaggtgcagcgtaaaatgcgagctaagttcctcgtcaatgcaacgccacactccggcattcagtccccatccgtgcagcagcacaagatgaacattcccctgacctttggtatgccaccagatgttattcatccgctattgttctctttttacttacaaggatgaacatatgctaacagtaccgggattatgctggctatgccgaatgccactggcgttaggtcattgggggatttgttcggtctgctctcgcgccgcccgtacagataaaacgttatgcccacaatgtggattacccgccacacactctcatcttccctgcggtcgctgcctgcaaaaaccgctgccctggcaaagactggtcacggtcgccgactatgcgccgccattaagtccgctcattcaccagcttaagttttcccggcgcagtgaaatcgccagcgccctgtcacgtctgttactattggaagtcttacacgctcgtcgcaccaccggcttgcaactgcctgatcgcatcatcagcgttccgttatggcagcggcgtcactggcgtcggggatttaatcagagcgatttgctgtgtcagccgttatcacgctggctacactgccaatgggatagcgaagccgtcacacgaacacgggccaccgcgacccagcattttcttaacgcccggctacgcaaacacaacctgaaaaatgcctttcgccttgaattgcctgtgcaaggtcgccatatggtgattgtggatgatgtcgttaccaccggaagtaccgtcgcagagattgcgcagttgcttttacgcaatggtgcggcgactgtccaggtctggtgcctttgtcgaaccttgtagagcctcgatgatgggcgtattataaccaactaaaatagtcaactattaggccattactatgatccgtatttccgatgctgcacaagcgcactttgccaaactgctggcaaatcaggaagaagggacacaaatccgcgtatttgtgattaaccctggcacgcctaacgctgaatgtggtgtttcttattgcccgccggacgctgtggaagccaccgacaccgccctgaaatttgacctgctgaccgcgtatgttgatgagttaagcgctccttacctggaagatgcagagatcgattttgttaccgaccagttgggttcgcagctgacgctgaaagcgcctaacgccaaaatgcgtaaagtggctgacgatgcgccgctgatggagcgcgtggagtatatgctgcaatcacagatcaacccacagcttgctggtcacggtggtcgcgtttcgctgatggaaatcaccgaagacggttacgccattttgcaatttggcggtggctgtaacggttgttccatggtcgacgtcaccctgaaagaagggatcgaaaagcagttgctgaacgaattcccggagctgaaaggtgtacgcgatctcaccgaacaccaacgcggcgagcactcttactactaagttctctccccttttgtcgattgcccgatgtgacgctaaagcgtcttatcgggcctgtacgttgcacgagagtctgacgttagcgcagaattacctcagcaaatccaatctcttcgtttccccacgataatatgaccaacctctcataatttaaatttaccccgctctggtgattctcaagcacgtaatgttacccgtatcattctcatgggcaccaaacacactcataacatctgactacactaactcgttttaggggtcatcagccgtggtgccgtaacatctctgttcccagttgggacaaccaggattttccgtcagaaacctgacgttacccataacaaattaaaggccaggtaaatcatgccattagtcattgttgctatcggtgtaatcttgttattactcctgatgatccgcttcaaaatgaacggcttcatcgctctcgtcctcgtggcgcttgctgttggattaatgcaaggaatgccgctggataaagttattggctccatcaaagctggtgtcggcggaacgctcggtagccttgccctgatcatgggttttggtgcgatgctgggcaaaatgctggcagactgcggtggtgcacaacgtatcgctaccacactgattgccaaatttggtaaaaaacacatccagtgggcggtggtactgaccggttttaccgttggttttgccctgttctatgaagtgggtttcgtgctgatgctgccgctggtgtttaccatcgcggcttccgcgaatattccactgctgtatgttggtgtaccaatggcggctgcactgtctgtgacccacggcttcctgccaccgcatccgggtccgactgcaattgccaccattttcaatgccgatatgggtaaaactctgctgtacggtactattctggcaatcccgaccgtgattctcgccggtccggtttacgctcgcgtgctgaaaggtatcgataagccgatcccggaaggtctgtacagcgcgaaaaccttcagcgaagaagagatgccgagctttggcgtcagcgtctggacctctctggtgccggtggttctgatggcgatgcgtgcgattgccgaaatgatcctgccgaaaggtcacgctttcctgccggtggcggagttcctcggtgacccggtaatggccacgctgattgccgtgctgattgcgatgttcacctttggtctgaaccgtggtcgttcaatggatcagattaacgacacgctggtttcttccatcaaaatcatagcgatgatgctgttgattatcggtggtggcggtgcgttcaagcaggtgctggtagacagcggcgtggacaaatacattgcttccatgatgcacgaaaccaacatttctccgctgctgatggcctggtcgattgctgccgtactgcgtatcgcgctgggttccgcaaccgtcgcggcaatcactgcgggtggtatcgcggcaccgctgattgcaacgacgggtgttagcccggagctgatggttattgcggttggttccggtagtgtgattttctctcacgtgaacgatccgggcttctggctgttcaaagagtactttaacctgactatcggcgagaccatcaaatcctggtcgatgctggaaaccattatctcggtgtgcggtctggtaggctgtctgctgctgaatatggtgatttgataatactgatggccggatgcggcgtgaacgccttatccggcctacgattcggcatcaaccgcactctacttcttcttcgctgccgctctgcgccgtctgtccaaatccttcagcaacttgttcacaccatcatcggcaaacatcgactcaagcgttgcggaaagtttacgtcgccagtttttatactggtaactggtgccgggaatatttaccggatctgccatatccagccagtcttccggctgtagccctaacagggcgctgttgctatcggcgatgtagcgctgtaagccacgattcagcgtcggcgtcatcgacatcaacgatgccttatgcccggcacgttttggcagacaaccatatttatgcagagcatccagtagtccttgcttcgccagttcgcgatcctgatacagaccgcgcagtaccacttcatccggatacaaccccagcgttttgcccagcgttagatccccgctctcccagtagccgcgtagcgtaggcaggtcgtgtgtcgccgcaaccgccatcgactgctctgggtacgctttcggcgcgcggaatgtcttctcgtggtcgttttcgaaatagagcactttgtaggagtacacaccgctgctgcgcagcttaccgacaatctctaccggtacggtaccgagatcttcaccaatcaccatacagcgatgacgcttactttcgagtgccagaatcgagagcagatcatccaccggatagtgaacatatgccccctgatctgccgtctcgccatacggtatccaccacaaacgcagcatcgacatcacatggtcaattcgtaatgcgccgcagttttgcatattggcacgcaacagctcgataaacggttcataggcacgcgcggtgataatatgcgggtccattggcggcaatccccagttctgccccaacgggccgaggatatccggcggtgctccaaccgacgctttcaggcaatacaactcccggtcgcaccaggtttctgctccaccctctgctacaccaacggccaggtcacgatacaagccaatcggcatttcatagccctggcttatctcccagcaggcggcaaactggctgtaagccagccactgcaaccagagataaaaatcaacgtcatcgcgatgttcttcgcagaactggcgcacttctggtgaatccacgttctgatacatctctggccatgcaggccagccccagcgcatttcgtcctctttcacttgctgggcatgtagtgcgtcaaacgccgcctgccagaacaggctgtcgccttgctctgcaacaaactggcgaaacgcggccatctgttcatcatcacgttgcgcgaaacctttccacgccattcgtaatgctgtcatttttagggcggtaaccgtggagtaatcgacccagtcggcatcccgcgcctgttgcagcgtctgttgcgtggtcggcaacttccaccaggcctgagcctcttcgctaagatggaaatcttcaacggcgttaacgtcgatataaatcacattcagccaacggcgagaagacgggctatacgggctggaactttccggatttgccggatagagcgcatgaatcgggttcagaccgatgaacgacccgccacgttttgccacatccaccagcatcgctttgagatcgccaaaatccccaataccccagtttttttccgatcgcagtgtataaagctgaacgcaggcaccccacagcttttgtttgttcagcaacgcctgcggttcgtaacagcgtttcggggcgacaatcacccggcaatgcgcgcgctggtcgtcctgggtaagcgtcagcgtgtgataaccttccggcagcttcgtcggtagattgaacgctttgccccccatcacatggcctttgtactgctttccttcttcggtggtcagcagccagctatattcgccgctgccctccaccaccatcggcatttttttgccgctggtataaaccatgacattcgggactggcgttaccgccactttcgtggcggtacgttgatgcatcgcgtcaagcaaacgccgtttggtttcggcgctaatcgactgcggtttaccgtgggcattgatgtaattggggctgatccccgccgccagcgcggcattatccagacgtttgctttccatcgagcttccttagcgttttgcctgccagatacgagcctgataatcgcgaatagagcgatccgagctaaacataccgcagcgggcggtattgaggatcgccgcgcgagtccaggcctcctggtcgcggtacagcacatccacctgcttttgtgcctctacataagcggcgaaatctgccatcaccagatacggatcgccgccctgtttgccgatactgtgcagcatctggtcgaaggcatgcttatcgccgtcgctgtatttaccgctttccagctctttcaatactgcgtccagcaccttatctttcttccgccatttcaccgggtcgtagcctttggccagaattgccttcacttgttccacggtatgaccaaaaataaagatattttcttcaccgactttctcagcgatttcaacgttcgcaccatccagcgtaccgacagtaagcgcaccattgagcgccagtttcatattgccggtaccggaagcttctttacctgcagtcgaaatttgttcggagatatccgccgccgggatcagtttttccgccgccgaaacacaataatccggcaagaaaaccaccttcaacttgtcgccaaccagcggatcgttgttgatcacgtcagccactttgttgatcgcaaagataatatttttcgccaggtagtagcccggtgctgctttcgcgccgaagaggaagacgcgcggtacgcggtcagactgcgggttttcacgaatttctttgtacaacgccagaatatgcagcagattcagatgctggcgtttgtactcatgcagacgtttgatctgaatatcgaaaatcgcctgtggattgatctcaataccggtacgaactttcacaaactctgccagacggactttattcgcctgcttgatctcgcgatattgctgacggaatttcgcatcatcagcgaatttttccagattgatcagttgatcgagatcgttagcccactcttttttcagtgatttatccaacagagccgccagtgccgggttgcactgtttgatccagcgacgtggggtaataccgttggtgacattatggaatttgttcggccatagctggtgatattccgggaacagatctttcaccaccagatctgagtgcagcgccgcaacaccgttcaccgcgaaaccgccaaccacacacaggttcgccatatgcacttgtttgtcgtgtaccaccgccagtttggcccacactttttcatcgcccggccaggttttctccaccagcgttttaaagcgagtattaatttcgttaataatctgcatgtggcgcggcagtaagcctttcaccagtttcacatcccagcgttccagcgcttctggcatcagggtatggttggtgtaagcgaaagttttgctggtgatggcccaggcgtcatcccagctcatctggtgctcatcgatcagcacgcgcagcagttctggaatcgcgatagttgggtgggtatcgttcagctgaataacttcgtaatccgccagttcgtgcagtttacgccccgccagatgatggcgacgcaaaatatccgctaccgagcaggcacactggaagtattgctgcatcaggcgcagctttttaccggcagtatggttgtcgtttggatagagaactttggtcagtttttccgcgttgatgccctgctgttcggcacgcaggaaatcaccgtcgttaaatttagtcagatcaaacggatgcgcatgcgtcgcctgccacagacgcagtggctgcgccacgccattacgatagccgacaacggggagatcccacgcttgaccggtaatggtaaactccggctcccagcgtccatctttcgtcactttaccgccaatccctacctgcacatccagtgcttcgttgtggcggaaccacgggtagttaccgcgatgccagtcatccggcgcttcaacctgtttgccatcgacaaatgactggcggaacaagccatattgataattaaggccgtagccagtagctgactgcccgacagttgccattgagtcgaggaagcacgccgccagacgtcccagaccaccgttccccagcgccgggtcgatctcttcttccaacaggtcagtcaggttgatgtcataagccttcaacgaatcctgtacatcctgataccagccgagattcaacaggttgttgcccgtcaggcgaccaatcaaaaactccattgagatgtagttaacatgtcgctgattcgccactggcttggcgaatggctgagcacgcagcatttcggccagtgcttcgctcactgccagccaccactggcgaggagtcatttcagccgcagaatttaagccataacgctgccactgacgtgaaagcgcttcctgaaattgcttatcgttaaaaataggttgtgacataggagttccacttttcttagattttcaacacaacgttatcgctagtttgccaggctcgatgttgaccttcctcatcctgcgggggattaggcagggaggagttgcggggatgagcaaggaaatgtgatctcgaccacttaaagctagtgcaatccacaggattagcagcaaatcaatgccataccgcgcagaaaatctgtatctaagtgcaaaaaatggccgttgcgtattttcaaaaagcggaaggtaactctataaattaagtaaaggagtgaaacagtttcacaagtaaaatatcaagtgtgctccatctcattcttaatagatttattaagatcatctttttagatggcactttcatcagaaatgaagaagaaacccttgcttaaatgaaactgatgaacataaggaaaataccgtacaacccagtattcacgctggatcagcgtcgttttaggtgagttgttaataaacatttggaattgtgacacagtgcaaattcagacacataaaaaaacgtcatcgcttgcattagaaaggtttctggccgaccttataaccattaattacgaagcgcaaaaaaaataatatttcctcattttccacagtgaagtgattaactatgctgattccgtcaaaattaagtcgtccggttcgactcgaccataccgtggttcgtgagcgcctgctggctaaactttccggcgcgaacaacttccggctggcgctgatcacaagtcctgcgggctacggaaagaccacgctcatttcccagtgggcggcaggcaaaaacgatatcggctggtactcactggatgaaggtgataaccagcaagagcgtttcgccagctatctcattgccgccgtgcaacaggcaaccaacggtcactgcgcgatatgtgacacgatggcgcaaaaacggcaatatgccagcctgacgtcactcttcgcccagcttttcattgagctggcggaatggcatagcccactttatctggtcatcgatgactatcatctgatcactaatccagtgatccacgagtcaatgcgcttctttattcgccatcaaccagaaaatctcacccttgtggtgttgtcacgcaaccttccgcaactgggcattgccaatctgcgtgttcgtgaccagctgctggaaattggcagtcagcaactggcatttacccatcaggaagcgaaacagttttttgattgccgtctgtcatcgccgattgaagctgcagaaagcagtcggatttgtgatgatgtttccggttgggcgacggcactgcagctaatcgccctctccgcccggcagaatactcactcagcccataagtcggcacgccgcctggcgggaatcaatgccagccatctttcggattatctggtcgatgaggttttggataacgtcgatctcgcaacgcgccattttctgttgaaaagcgccattttgcgctcaatgaacgatgcactcatcacccgtgtgaccggcgaagaaaacgggcaaatgcgcctcgaagagattgagcgtcaggggctgtttttacagcggatggatgataccggcgagtggttttgctatcacccactgtttggtaacttcctgcgccagcgctgccagtgggaactggcggcggagctgccggaaatccaccgtgccgccgcagaaagctggatggcccagggatttcccagcgaagcgattcatcatgcgctggcggcaggcgatgcgctgatgctgcgcgatattctgcttaatcacgcctggagtttgttcaaccatagcgaactgtcgctgctggaagagtcgcttaaggccctgccgtgggacagtttgctggaaaatccgcagttggtgttattgcaggcgtggctgatgcaaagccagcatcgctacggcgaagttaacaccctgctggcccgcgctgaacatgaaatcaaggacatcagagaaggcaccatgcacgcagaatttaacgctctgcgcgcccaggtggcgattaacgatggtagtccggatgaagcggaacggctggcaaaactggcactggaagagctgccgccgggctggttctatagccgcattgtggcaacctcggtgctgggtgaagtgttgcactgcaaaggcgaattgacccgctcactggcgttaatgcagcaaaccgaacagatggcacgccagcacgatgtctggcactacgctttgtggagtttaatccagcaaagtgaaattctgtttgcccaagggttcctgcaaaccgcgtgggaaacgcaggaaaaagcgttccagctgatcaacgagcagcatctggaacagctgccaatgcatgagtttctggtgcgcattcgtgcgcagctgttatgggcctgggcacggctggatgaagccgaagcgtcggcgcgcagcgggattgaagtcttgtcgtcttatcagccacagcaacagcttcagtgcctagcaatgttgattcaatgctcgctggcccgtggtgatttagataacgctcgtagccagcttaaccgtctggaaaacctgctggggaatggcaaatatcacagcgactggatctctaacgccaacaaagtccgggtgatttactggcaaatgaccagcgataaagccgccgctgccaactggttgcgtcatacggctaaaccggagtttgcgaacaaccacttcctgcaaggtcaatggcgcaacattgcccgtgcacaaatcttgctgggcgagtttgaatctgcggaaattgtcctcgaagaactcaatgaaaatgcccgcagtctgcggttgatgagcgatctcaaccgtaacctgttgctgcttaatcaactgtactggcaggccggacgtaaaagtgacgcccaacgtgtgttgctggacgcattaaaactggcgaatcgcaccggatttatcagtcattttgtcatcgaaggcgaagcgatggcgcaacaactgcgccagcttattcaactcaatacgctgccggagctggaacagcatcgcgcacagcgtattctgcgagaaatcaatcaacatcatcggcataaattcgcccatttcgatgagaatttcgttgaacgtctgctaaatcatccggaagtgccagagctgatccgcaccagcccgttgacccaacgtgaatggcaggtcctggggctgatttactccggttacagcaatgagcaaattgcaggcgagctggaagtggcggcaaccaccatcaagacgcatatccgcaatctgtaccaaaaactcggtgtcgcccaccgtcaggccgcggtacaacacgcgcagaaactgctgaagatgatgggatatggggtatgagtttagccggataatgcgccagatccggcttacatctttacatcattcaatgctcacccgcgttacgccatctgtttctatcagactaaaccgcactggcaagaaacgctccaccaccgcgatattggtctgcagatggcatgagggatgggcgaccgtaaattctcccgcccccgccagcgccatcggtagcaccagttggtcggcgagatattcccccaccgccgccgggcttgccaggtagcgtttcacctctttcaccaactgtgccgcgaccacctcggcactgacgcgcttttcaccgacgacaaaaaagcgttcggtgatattttcactttcgacttcaagcgagacggtattacccggcccctggtcgcgcggcaggttatgaatattctgttcatgcaaggaaaaactacccgccagtgtagcgatttcacgctcagcaacatggcgcggcacaccagccagtagcacctctccacgcatctgcacaatgttcccgcgctcgccaagttgcaagctattaaacgatgccaccggtgagacttccgttgccaccacgccgcctccggcaggataaaaaccgtgacgtaacagcgtggtttgctgatgaactcctattttcgccagcagcggctccagcacccggcggataaaatccgcaggcggggccgacgggttatcggtgccgccgctcacttcaacacgcgaaggtccatcggcaaaccacagcgcgggcagcaccgtttgcagcaccagcgtacaacttccggcgctaccgatagcaaagcggtaatcgccgccgcgcacggtgccaggtcggaagaccagacgctgcgaccccagctcagcgccttccaccgttgccctacaaatttccgcagccgcttttaccgcggtcagatgttggcgcaacagccccggtttcgcccgcccggcacgaatgccggtgatggtaaatggctggccggttatcatcgacaggctcagcgccgagcgcaggatctgcccgccgccttcgccctgtgcgccatccagcgcaatcatccttttcatcatttatccttttacgcacaccacctgacgcagggtatagataacttccaccagatcgctttgtgccgccatcaccgcatcaatatctttatacgccatcgggatttcgtcgatcacctcggcatctttacggcactccacatgcgcggtggcacggatttgatcttccacactgaacagttttttcgctttagtacggctcattacccgcccggcaccgtggctgcacgaacagaacgactcttcatttcccagcccacggacgataaagcttttcgcccccatcgaaccgggaataattccatattgaccagcacgcgcagacaccgcgcctttacgcgtcacatagatctcttcgccaaagtgctgttctttttgcacatagttgtggtgacagttgatctcttccatcgccagcgtttgtggctgttttaccgttttctgcgtaacgctctgcaacgccgttaccacgttttccatcatcgcatcgcggttaaggctggcaaaaagctgcgcccaggctacggctttcaggtaatcatcaaagtattccgtaccttccataaagtacgccaggtcacgcgatggcaacgtttcaagcgtttcctgcatctctttttgcgccagatcgataaaataagttccgatggcgttaccaattccgcgtgaaccggagtgcagcataatccacacctgatccgactcatcaaggcaaatttcaataaagtggttacccgtacccagcgttcccaggtgtttatagttattagtgttaaggaaacgcggatatttttgcgttaaccactgataaccggcctccagctcagcccatttcgcatcgacgttaacaggcggattttcccatgcgcctttatcacgtttacaacgcccggtagtacgtccgtgcggtacggccgtttcaatcgcctgacgcagctctgccaggttttctggcaggtccaccgccgttaacgcggtacgcagtgcgttcattccacagccaatatccacgcccaccgccgccggaataatcgcccctttggtcgggatcacgctaccaatggtggaacctttacccaggtgtacatcaggcattaccgcaatatgtttgaaaataaacggcatcttcgcggtattaataagttgctgacgcgcatcggcttctaccggcacgcctttggtccacatttttaccggagcattttcagtggtcagtaattcgtaattcattttgtttttctcttttcgttgtttgctgtcctgataattgcaaccgtcgtgccagaaaatcaaataagcatcttaattttttaattcattgtttttaaaaatattatatttttacgtccgtaaacggagatttcccgcaaagccgatttaccgataatgaaatctcgtcttttataaggatatctaagatgcgtaaaacagtggcttttggctttgtcggaacggtgctggattatgccgggcgcggcagtcagcgctggtcaaaatggcgtccgacactctgtctatgccagcaagaatcgttagttatcgatcggctggaattattgcacgacgcccgctcgcgctcgctattcgaaacgcttaaacgcgatatcgccagcgtttcgccagaaacagaagtggtgggcgttgagatagaactgcataacccttgggatttcgaagaggtttacgcctgcctgcatgatttcgcccgtggttacgcgttccaacctgataaagaagagtatttaattcacatcaccaccggcacccacgtcgcgcagatttgctggtttctgctggcagaagcgcgttacctgcccacccggttgatacaatcttcaccaccgcgcaaaaaagagcggcccgatagccctggcgcagtgacgattatcgatctcgatttaagccgttataacgccatcgccagccgctttgccgaggaacgccagcaaacgcttgattttcttaagtccggtattgccacgcgtaactcccacttcaaccgcatgattgagcagattgaaaaagtggcgataaaatcccgcgcaccgatcctgcttaacggcccgaccggtgcaggtaagtcatttctggcacgacgtatcttcgagctaaaacaggcgcggcatcagtttagcggcgcgtttgtggaagtgaactgcgccaccctgcgcggcgataccgccatgtcgacgctgtttggtcatgtgaaaggcgcgtttaccggggcgcgggaatcgcgtgaaggattattacgcagcgccaacggcggaatgttgtttcttgatgagattggcgaactgggcgcagacgaacaggcaatgctgctgaaagccattgaagagaaaaccttttacccgtttggcagcgatcgccaggtgagcagtgattttcagcttatcgccggaacggtgcgcgatttgcgccagttggttgccgaaggcaaatttcgtgaagacctgtacgcgcgaataaatctctggaccttcaccttgccaggattacgccaacgccaggaagatattgaaccgaacctggattatgaagtggagcgccacgcctcactcactggcgacagcgtgcgttttaacaccgaagcgcggcgtgcctggctggcctttgcgacctctccccaggcaacatggcgcggtaactttcgcgaactttctgccagcgtcacgcggatggccacctttgccactagcggacgcatcacactggatacggtggaagatgagatcaaccgtctgcgctataactggcaggagagtcgcccctccacgcttacggcgttgctgggcgcagaggcagaaaacatcgatctcttcgaccgtatgcaactggaacacgttatcgctatctgccgccaggcaaagtcgctttctgctgccggacgtgaactgtttgacatttcgcgccagggtaaagccagcgtcaatgacgcggatcggctacgcaaatacctggcgcgttttggtctgacatgggaagcaatgcaggatcagcacagctccagttgaatatgatggtccttcagcacctgcatcacgctcgcaggcggcatcgtgtcggtgtagacagcatcgaccatgctgatgctacccatattgaccattgcgttacggccaaattttgagtggtcgacaaccagcataacgtggcgcgagttctcaatgatggcgcgtttggtgcgaacttcgtggtaatcgaactccagtagcgagccgtcgctatcgatgccgcttatccccagaatgccgaaatcgaggcggaactgggagataaaatcgagcgttgcttcgccaatgatcccgccatcacggctacgcaattcaccaccggcaagaatgatacggaaatcctcttttaccatcagcgtgttagcgacgttgagattgttggtcacaatgcgcaaattgctgtgattaagcagcgcgtgcgccaccgcttccggcgtggtgccgatatcgataaacagcgtcgagccattgggaatttgctccgccactttgcgggcgatgcgctctttttcttcggtctgggtggccttgcgatcgtgccacggcgtgttaaccgaactggaaggcagcgccgcaccgccatgatggcgcaggatcaggttttgctctgccagctcgttgagatcgcggcgaatagtctgcgggctaacggagaaatgctctaccagctcctcggtgctgacataaccctgctgtttaaccagttcgataataccgttgtgacgttgtgtttgtttcattgataaatccctggaattattttcgttttcgcgcattgagcgaatcaacaaaagccatcgctaaacccacggctaacccggcgatgtgtgctccgttcgccatcgacatcccaaacaaatcaaaccatccggcgacaatccagatcaacgcaaagataattaacccacgttgcaggtaaatgccactttgcggatcgcgttcgccacgtagccagacgtagcccatcagcgcatacaccacgccagaaagcccgccaaaccacggcccgctgaatttttgctgcacatagccgcttaacagggcgctaatgagagtaatgacaattagcttaccgctaccgaggcgtttttccaccgcaccgccgagataccaccaccagagcaggttaaagaggatatgcatcagcgagaagtgcattaacgcgtgggtgaagtaacgccagaactcaaatttcagcgtcggatcgaatggccaggccagccataacatcacttcttgatcgccgagaatttgcatggcgataaacaccaccacgcaggcgatcatcatcacccaggttaccggacctgcgcgttcacgcaaggcagcaaagaaaggataacggcgataatgcaggccactgtcggtatgaccggactgccaactggccgccagataacgcggatctgccgggtttccgagaaaacgcgccagctccgcccgcacgcgttcggcctgggactcatccgccagccagacatcgctttggttatgttgttgaatcgtgaggataacaccctgcgtcgccatgtaatcaacaaacgcctgcgccacgcgggggttagcaaaagaggtaatcatcaacatcgttgctgtcgcttattccacacaaaaggggacagtataaagcgttacgcgccgtacgccacctctgcgggaaactggcgctgccaggcttcaaagccgccatcaatgctgtagaccacatcgtagccctgttgcagcagatactgcgccgcacctttgctgctattaccgtggtaacacatcaccatgactggcgtatcgaagtcgttatcacgcataaacgcgcccagtgtgtcgttagttaaatggaaagcctgcgccgcatgccccattgcgaaactctgtggatcgcgaatatcgaccagcaccgcctctttttcctgcaacttctggtgcgcgtcggcaacgttaatacattcgaactgatccatgcgtctctctttctttacaaacaagtgggcaaatttaccgcacagtttacgtcgaagcggcagataaacgccataatgttatacatatcactctaaaatgttttttcaatgttacccaaagcgcgattctttgctaatatgttcgataacgaacatttatgaactttaacgaaagtgaatgagggcagcatggaaaccaaagatctgattgtgataggtggcggcatcaatggtgctggtatcgcggcagacgccgctggacgcggtttatccgtgctgatgctggaggcgcaggatctcgcttgcgcgacctcttccgccagttcaaaactcattcacggtggcctgcgctaccttgagcactatgaattccgcctggtcagcgaggcgctggctgaacgtgaagtgctactgaaaatggccccgcatatcgccttcccgatgcgttttcgcctgccgcatcgtccgcatctacgcccggcgtggatgattcgtattggtctgtttatgtacgatcatctgggtaaacgcaccagcctgccgggatcaaccggtttgcgttttggcgcaaactcagtgttaaaaccggaaattatgcgcggattcgaatattctgactgttgggtagacgacgcccgtctggtactcgccaacgcccagatggtggtgcgtaaaggcggtgaagtgcttactcgtactcgtgccacgtctgctcgccgcgaaaaaggcctgtggattgtggaagcggaagatatcgataccggcaaaaaatatacatggcaggcgcgcggcctggttaatgctaccggcccgtgggtgaaacaatttttcgacgacgggatgcatctgccttcaccttatggcattcgcctgatcaaaggcagccatattgtggtgccgcgtgtgcatacccagaagcaagcctacattctgcaaaacgaagataaacgtattgtcttcgtgatcccgtggatggacgagttttccatcatcggcaccaccgatgtggaatacaaaggcgatccaaaagcagtgaagattgaagagagtgaaatcaattacctgttgaaagtgtataacacgcactttaaaaagcagttaaaccgggacgatatcgtctggacctactccggcgtgcgtccgctatgtgatgatgagtccgactcgccacaggccattacccgtgattacacccttgatatccatgatgaagacggcaaagccccgctgctgtcggtattcggcggtaagctgaccacctaccgcaaactggcggagcacgcgctggaaaaactgacgccatattatcagggcattggtccggcgtggacgaaagagagcgtgctgccgggtggtgccattgaaggcgaccgtgacgattacgccgcccgcctgcgccgccgttacccgttcctgaccgaatcgctggcacgtcactacgcgcgcacttacggcagcaacagcgaactgttgctcggcaatgcaggggcgataagcgacctcggtgaaaatttcggtcatgagttctacgaagcggagctgaaatatctggtcgaccacgaatgggtccgccgcgccgacgatgccctgtggcgtcgcacgaaacaaggcatgtggctaaatgcggatcaacaatctcgtgtgagtcagtggctgatggaatatacgcagcagaggttgtcgctggcgtcgtaaggatgatgcccggttgcgaagtgcaaccgggctatttgaattccttagactattcattgtaaataattgaataacggccccagagctaaaatcgccaaacttaagcacgttacccaatcgccccacttcttcctatggcttctatttttgctacgccactggcaataatatcccaacgcaaaaccaagctgggcactaatcgggccgacaaaatcagtccacggctgcggccaaaaaggggaaaaattcaggggaagccagacaaatgtcagaaagaaatttcggatattttccagcaacgctgatttctctggagaaatataaagaatgaaattcgagagaattaaccagaaatagaccggagaaaagaccagccagcaatgtagcctgttttttaattcaggaggcgttctgcgggagaattgccaaccgatgccacccattacactgaaaaaaagtgcatattcaaccaataactcaagttgtaattcctgaagagaaatacgcacaaccaggagcggaaaggagaatattatttccgtcagaaaagttaacgtgaatataagtacggctaaggcaataaccgtcggccataccaataatggtacgataacaaaaccgagaattacagggggaatataaagccggaatttaatcatttttattttcctggtgattcggatgatgcgtcatacatcgcgcataaacactcatcaatcatccagtcgtcttcccagatctgatactgtgtgccctgttcgggctgcttaagcgggttctcaatcgcctgccgcgcgcgttctttcaggatggattgattgttgaaggcccaggcattgatttgggcggtaatggctttatcgatatcgtcctggttatctctgatataaccgtcacgatacgtattcaataaacaggcaagagacgctgccgaccaaaatccgggaactgaaataatggcatcaagcaatggcgaaagagcgatatcggcacggaaaaacatttccagcttgtactgtaattcgacagcctcatccccggatacccaatcagtcatatactggcaagcaaattgctgcaatatttcccgttcatcctcacgccagttttctttactggcaaggtttatacgccgtagagaaaatacttcgtgaatattgtcaaattgcccctgcgcaacaaactccagtaaacgaggcagaaaataacgaacctcatcgctgttttgcggatcaggtcctggactactattccaggcattgattaaggaataaggaatcgctcgcaacgatgtattccgtaatgctttttgttcctgttgactcagacaatattcacaacaaaccacaaattgcttcggcgccggataacgacgaaaaatatgatatatctgctcaattaatgcctgcatggcaggagtggggtgcataattaccccctcgcccgctgatcgcgtgtaaagggttgatagacaaaacgagcattcgccgcattcaggcgaataatggcactacgagagagggaaaagctgggccgaatgcaataattacagtcccaacagctttcctctgtgcaattttccactgagtaatgacgcacgtagagtttcagttcagcctgcttatcgcgaaatccgcgtaaactgttatcgttttgaaattgccaggcttctttaaacacttgaaagatataaacatcctcaatccaggcgtcacattttttaagcggacgctttgctatgatcacccgctcatccgggttgagcatcgccgtaaattgtacggtgaagtcatttgtcgtgttcagatcacattgaacatctggtacatcactgatatagaggtcaaatccaaagtcagcaccacaggcacaaagacggctaatggtggcggtatcgagggaaaatcccggccatacattgctggacgttaaaccaatatttaatgtgacatcatatcgagataatccctcaagaccggcagcaccggcgaacttttccccttcatccaggacctggttaatgagttgctgaacaatgccttcatcccagtatgttgatttgcagttggcaatcgtaatatccacgccagtgaatggatcagtaccggagaggcttgcaaataacgtatcaactaattccatttttattatccggcttaatgcaacattttattcatcggcacataacctacattttccaccaggtttttcccctgtagaattaaaaatatttttttgttttacattctgttcatccctattattgcattttattttgcggtgatagctaaaccgactctgtactggctcaaaaattactgatattccactcgcaatatagccagtgcattataacgacctgccgcaggcacttttccagttgtactaacaggtaaagtcagaaaagtaacatcagcagtttgcgcagaagcagcctggttttccaccaatctgaacggaacgcctactgatgttgccagggcatttaaatctacggagttttgctgactatccataatcataataccaacatcaggattatcttgtgcctgaataatactttgtttcccattggtatcacgtgtggcggaaatgttaccgtcgaataccaacgtcattaccgcatctgtatctttattcgtacaattaatcggaatagttgttgctacaggagtaacaccagcgggcttcgctccggcaccagcccggctcaattcactggcccacacatccggcatattaacagtaaaactcgtaccctcattaatagtgcaaccttgcggaacctgaatatttaagtttcctatgtaggcattaaagacagggataggaccatgttcggtagggatctggctgacatataatgacaccaataatacgttacttaatgaaacatcagatataatttttttatcaatcctgattttaatatatccttcagtacctgatgcccaattagatggtttgcttctgtcccccggataattggtattataattttcgaatggcacaattttatctgtcattgtgccattttgattataaagttttatatgagtagagacagatatttcatgggtgagtggaataaatacatcactcccttgatgatcaccactggcaccagacggatctattccagagacagcactgaagtaaatttcataatcatcaagagaattacaataagccttataggttccaaccttccagatttgtgatggcaatacagtgccaggcgcatttttgttgacatcagaaaccactatagtaccaaaattataagaaaaggatgcaggcgtagtattattactcggtgaacccggataacaatatgcacgttctcgccccatatcttcagcattagcaatagaagaaagaacatttgaaaatataataatcaataaaatgaaatatcttctataccaataagtatgtatacgcatatcatgtcctcagatatattattgactaaatgcaaagccagtaaaatccaactgtgggtaatgactccaacttactgatagtgttttatgttcagataatgcccgatgaccttgtcatgcagctccaccgattttgagaacgacagtgacttccgtcccagccttgccagatgttgtctcagattcagattatgtcgctcaatgcgctgagtgtaacgcttgctgataacgtgcaactttcccttcaggcgtgattcatacagcggccagccatccgtcatccataccacgacctcaaaggccgacagcaggctcagaagacgctccagtgtggccagagtgcgttcaccgaagacgtgcgccacaacagtcctccgtatcctgtcatacgcgtaaaacagccagcgctgacgtgatttagcaccgacgtagccccactgttcgtccatttcagcgcagacaatcacatcactgcccggttgtatgcgcgaggttaccgactgcggcctgagttttttaagtgacgtaaaaccgtgttgaggccaacgcccataatgcgtgcactggcgcgacatccgacgccattcatggccatatcaatgattttctggtgcgtaccgggctgagaggcggtgtaagtgaactgtagttgccatgttttacggcaatgagagcagagatagcgctgatgtccggcagtgcttttgccgttacgcaccacgccttcagtagcggagcaggaaggacatctgatggaaatggaagccacgcaagcaccttaaaatcaccatcatacactaaatcagtaagttggcagcattacccaactgtgaaggatttaattttactttcaaaattggcaatacattattataaacatccaaagtttgccatgctatttcacaaaccccttgcgatttacaccatgattgttggcgatggctaaatggtgcgaccataccaccatctataactttaccatcaacatgtaggttatagagtgtcacatatctggggcctggattataaacggtaaccatttcattttttcgtgcccagcgtaatttttgatatgacatattcgggtcttcagacaaatttgatggccggtagaatattttcatccgattgcggactgctatttgcaattgattatcaattttgactgaatgactattttccaacgttggtaatgctgcaacattcagtataaataaactttcccggtcggtaggtaaactgccaccaacacgattaattcttatttttgtatttttgtcaggcttcaaaacaaacagtggcggagttgcgataaataccgtttcagaatatgagggcaaagattcaaccgttcccgtcaactgacgagcatcatcaggggagactgcaaccttgactaacatatctctgtctgaagtatttttgagttcaacagatattgaggactgattttccggatacgcaaaacgcgttccaccgatcactaagcctgcttgtgctgtagagaataaaagggaaaataatactatgactaccttaatcataggtgacaataaacgatactgacgcattggcatcccctggttggacattattttttaatgctttgtaagccgcaaaaaaatgcaatatattatcaactgatggtgtaagtgaaaaaacgatgcttttaacatcattactaatactacctttattcttatcaaaaatcgtgagtgcaagcccctctaccgagccttcttccagcttatataaactggcatcttctgaaactgtattaccggtaaactttatataagcgttgccaacatcactaccacagcgggttaacgttatggaaaaataaaccttttcagtaacgtctcctgcactccttaccgaactactgggtacgtctggcatattaactgtaaaattttttgactcatcagaaataatgcaggttttttcggtaattaacccttcaatacgaactactccggcatgagtgatatcatcagcaaaagaacttgttgatattataaacaaaaataaactaatgaatatcttcatatctccctcactgataatcgatatcaaaatacaacagagcatttgcttgcccggcatgtacattttcctgagttgatttatagcgaagtttaaacgtcaaattagcatcaccgttttcatttaacactaaatcacgaaaacctgattcaccattaatggcaatcgccacatcattgttatccaatatttctattcccagtccagtcgcactatctgcaccggcggatagacgcagtaatgcgctattaatggcatctgcatcaccagtaaaccgcacattggcgctcacaccagaactataaactgtactttttgcagtcgggcatccttgtacattaatcgtaaacgtttgactcggagaaacatcacctacatttaaaaattcattagcatcataagtgcccatttttaccgactgatctttacttccggtagtaatgtcacagctttttgccaacaaaatcccagtaaatgtaacaacaactgaatcattggcctgccctgagagcggaaaagcaaaaaaaacgaaaagaataaaaaatacagaatatttagagaatattaaattcattagcggcactccagagttgggtaatgctgccaacttactgatttagtgtatgatggtgattttaaggtgcttgcgtggcttccatttccatcagatgtccttcctgctccgctactgaaggcgtggtgcgtaacggcaaaagcactgccggacatcagcgctatctctgctctcattgccgtaaaacatggcaactacagttcacttacaccgcctctcagcccggtacgcaccagaaaatcattgatatggccatgaatggcgtcggatgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacagtggggctacgtcggtgctaaatcacgtcagcgctggctgttttacgcgtatgacaggatacggaggactgttgtggcgcacgtcttcggtgaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaagttggagtcattacccaggcgcttttatcaaaacattagtttcacctaatggttgactcaacgtaagaccattttcatgtacaacaagagcaccactgatgccatagtttatttgttgattaccttcattatcgtaactgtaggcggaattcaaggaaccatatgccccacgataattaacaccaacagaaccactactgctattatcctgattagcaaaaccatgttgtatgttataactgagattatgctgctccaacagagaaccagatacccccgtatattggtttacctgtccgtggttatcctgactataaccatacgttgcagtcatggcattcgatgatgagcgcccatcattcgtggaagataaccaattacttataggtaatgagacatttagcgagacaattttatccgcatttgtccctggtgatttactgtaattccacgcaacatttagatagatacccttaatactgttgttataaccaacttggtataaagaatcttttttatcagtattccagtatgtttgctgactagccgataaatacatagacccgtagttaccgaaaggttgcgatacactagcctgaaattttccacgtttgctataacgcaagttataaaaatcattccagttataaacgtaatctttatcatctaacgtttttggatcaacaacagtccctgacatttgttggtatgtcgtatcacttaaagtgtaaaagccctgggttgaataacgatagccaataatatggaatgctgttcctgtctgaactaacgatttggaataaagaaaacgataagattgcccttgatgtttgctcccatccacaagcgaactgttagcctgagtaacatcaaacgatgttgcaccaaatacacccagattcaggccaaggccgagcgccaacgcccggtaatcctcagagaattgtgccccaccataagccgtaatatcccagggtaaaccccaaattaattccccctgaaatacataaggacttttctggttatagctattgcttcgatattggccaaccgtagtagaatattttaaatgaccttctcgttgcaggatggggacagcggcataaggtacggtatagacagtttctgaattatcagactctttgatggtaacttccagatctcccgcagatgatgtcgggttaagatcgctaatctcaaacggtcccggcggcatataggtttgataaatgacataaccattctgtttgattgttacctgagcgcgacttttcgcaattccgcgcaccgtgggagcgaaaccactttgactatcgggcaacatattttcgtcagattccagttttatgccacgaatactaacactgtcgaaaacatctgatgatgaccatgtatctcctagcgttaattcacttctgaaaggaataataacgcgctgcaacgtactactgatatgctccagtttacctgctgaattactcccacgactccaggttgaataatcgcgaaaacgccatgcaccaatattgatcccagcgcgaagatttaaataatagttatttgaagagtaatcaacacgatcgttattaccagaaaagtcataattcagcaaaaaagctgtaataccgttatcccactgttctggtggaatatatccgcgagcgtcacgttttattatcgcctgtggaaaggtcagtttaagtctctgtgcatccagctccggcatgtaatgcacatcgggaaaccagatacgcaaatcaaggcaactattttcagatgaagccaaagcctgctctggcagcgcatttttgttaattccaaggcttaataagtcagcaagtgaaaggcagggaatcagttgattctcatcgtctgctttaaaagttacagtacgagagagtaaaggggaatcattgacccaaacttcgacttcatagctaccaggaagataagtcatccctttctcgaagcgggataagtcagcaacagcttcagtatcacccgacagaaaagcagggttaaagcgcattcccgcgattgaacatgcaggcataataaccagaagaagcggcacaacccgtttcatctgcttttgtgccgccatccaatattcgcatcttttgagctttaggttcatatccctgacctgtgttgcatctgaactattccgttgttactgcattattcctttctgccgctccgtcgtagcgccaaagtcattaattgtttgataagtaatttcaccagccaacgtcactggcgacgagaccgtaatatcacttttcggtggtacaaacatattgggcaatttactcccttgtactttaattcctgtcagtgtcaggtaataaggcgaaggattgataacttttagttgtttgccctcatacttaaaccgcaacatatttcgtgcttttcctggttgcacaggtagattttccgggcgataaaatagcttgattttgttttgtaatgccaactgtaaggtattcttctgtgtatttttctcatctgttggcggaattgctttaacattcatccaatacaaagtttcacgatcggtcggcaaattagtcttaccaagaaacatgatacgtaatgaagcttctttacgcgttggtaacataaagaggggaggagtgataacaaaatcctggctctttttttccgttttactgtcatcaacccatgattgaattaaataactggtgttgtcaccgctattttgcacactgagtgttatttgcttactttctgccggataaatcaatcgcgttacgccaaggccaaacccgcccgcggacgcattattaataaataatatcgatagtaaaaaaagaatccctgagcgtataatattttgtgatacttttaattcatccctgaatccataaacccattttttatttccaataatacatttcatacagcatccttgttgatgaaataacacctgttattcatactctattaaataatttcaatctcaggttacaactttttgtaacctgaaatcgtatttatatttactcgtacagcaccacaaaacttgctgttgacttaactacaccaggtgcaacagtgctaccgttttgagcataacctgcagtaaaggccgcgctgaaatcatgggtcgtagcatttcctggaattgtataagcggcggtggaggcgctaccctctgccgcagtagtattcaggttaatcagaccattattcgtcgtacctttggagtaaattcgaatccctacaccagtcgcccccgcattgccgctgttgtcagcatccgttgatccttctacttcgttagcgagcgttttattagcgctatctgcagtaccggtaaaacggaactcaattttctgatcctctgtattgctacattcggtcagattaatattgaaatcggtctggttgctcgcccctgtgcttctacgtcgataccagtgaaaaggttggaaggcacaaccggcaggacaacttcaatctgttttgaatcggttgcgaccttacaggtagctttcactacacggccagtaaagcggattttcccccccattgaatcaacgttgtcatccatatcagtgagcctgggataatcaacggtgctccagtcagtatccgccccaccaaattgtgttgcatcgccgggtgctgcggttaccgcagtagacatcagcatacctgatgccagtaatactgcagataaattagataaattgaatttcatttatacctttccttttgttaaaaaatccaagcaacattggtgtttttacattctgcgttaataagttatatctcacaaaaaaaataagctgacgttggctaattccagaaggttctttagaagagtaattgagtgagtaatattatatatgctgcttagtaatgtacctaaaataatccggtaatgctgccaacttactgatttagtgtatgatggtgattttaaggtgcttgcatggcttccatttccatcagatgtccttcctgctccgctactgaaggcgtggtgcgtaacggcaaaagcactgccggacatcagcgctatctctgctctcattgccgtaaaacatggcaactacagttcacttacaccgcctctcagcccggtacgcaccagaaaatcattgatatggccatgaatggcgtcggatgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacagtggggctacgtcggtgctaaatcacgtcagcgctggctgttttacgcgtatgacaggatacggaggactgttgtggcgcacgtcttcggtgaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaagttggagtcattaccaaataatccaaagccgcaataagtgagtttatactcacatataacacactgataatgataaaatttatttttacgtggagttgtaagaggggcaataaaacataaatcacatgaataatattaatgcattcataataaattaatattatttgaaataacaaaataccaaaaacattatcatcaatcgttatttaatatatattaatggtatatattaaatagaataacatacatcaaagttattgtttattgtgtatagaaataccgtgagttccactctgtattacttcagcggaacacacggtatttagccgtatttgaacttacaatctcaccggatcaatatgccagatatgatcggcgtactctttgatcgtacggtcagaagagaagtagcccatattggcaatgttcagcatcgcttttgcggtccactcttcctgacgctcgtagagttcgtcgactttatcctgacaatcgacatagctgcgataatccgccagtacctggtagtgatcgccgaagttgatcagcgaatcgaccagatcgcgatagcgacccggatcttccggactgaatacaccgctgccgatttgcgtcagcacctgatgcagctcctcatctttctcgtagtattcacgcggtttgtagccctgacgacgcagttcttccacttcttccgctgtgttaccaaagataaagatattgtcagcaccgacatgatccagcatctcgacattcgcaccgtccagcgtaccgatagtcagcgcgccgttaagcgcaaacttcatgttactggtgccggaagcttccgtccccgccagcgaaatctgttcagatagatcggccgccggaatgatcaactgcgccaggctaacactgtagttcgggatgaacacgactttcagcttgtcgccaatctgcggatcgttgttgatcactttcgctacgtcattgatcaaatgaataatgtgcttcgccatgtaataggccgaagccgccttaccaccaaaaatattcacgcgcggtacccacttcgcatccgggtcggccttgatgcggttatagcgggtgatcacgtgcaacacattcatcaattgacgtttgtattcgtgaatacgtttgatttgcacatcgaacagcgctttcggatttaccaccacattcagctgctgggcgatatactccgccagacgctttttgttctccagcttcgcctgatgcaccgcgtgattaaccattgggaaatcacagtgttgttgcagatcattaagcaggctaaggtcggtgcgccagttgcggcccaggtgttcgtccaacacggctgaaagcgatgggttcgctaccgccagccagcgacgcggcgtcacaccgttggtgacgttggtgaaacgacccgggaagattttcgcaaagtcggcaaatagcgattgcaccatcaggttagagtgcagctccgatacaccgttaactttgtggctcaccacaaccgccagccaggccatacgcacacgacgaccgttggattcatcaatgatcgacgcccgtcccagcagatcggtatcgttcggatactgttcctgcaaggttttcaggaaatagtcgttgatttcaaagatgatctgcaggtgacgcggcagaattttacccagcatatcgactggccaggtttccagcgcctcgctcattagcgtgtggttggtgtaggagaagacctgacaacacacttcaaacgcgtcgtcccagctaaattggtgctcatcgatcagcagacgcatcatctcaggaatcgacagcaccggatgagtatcgttgaggtgaatcgcaattttatccgccaggttatcgtaggttttatgcaactgataatggcggcttaaaatgtcctgaatggtcgaggaaaccaggaagtattcctgacgcagtcgtagctcacgcccggagtaggtggagtcgtccggatacagtacgcgagatacgttctcggagtggtttttatcttccactgccgcgaagtagtcgccctggttgaatttaccgaggttaatttcgctactggcttgggcactccacaaacgcaacgtgttggtcgcgtcggtgtcgtaacctgggattatctgatcgtaagctactcccagaatctcttcggtttcaatccagcgcgtttttttaccttcctgctgaatgcgaccgccaaaacggactttatagcgcgtgttgtggcgtttgaattcccacgggttaccgtattccagccagtagtcaggcgactctttctggctaccgttaacgatgttctgcttgaacataccgtagtcatagcggatgccgtaaccgcgccccggcaaccctaacgtcgccagagaatcgaggaagcaagccgccagacggcccaggccaccgttaccgaggcccgggtcattttcttcatcaatcagctcttcgagatttaatcccatcgcttccagtgcgccctgtacatcttcgtaaattcctagcgacaacatggcgttggaaagcgtacggccaatcaaaaactccatcgacaggtagtaaacctgacgagtttcttgcgacaactgggcacggtttgagcgtaaccagcgctccacgagacgatcgcgcacagcaaataacgttgcgttcagccattcatgtttattggcgacgaccggatccttgccaatcgtaaacatcagcttgtaagcgatagagtgcttaagagcttctacgctaagcgtgggcgatgaatatgtaaacggagcattcatataggcgtttcctgaaaactatttcaagcgatagtaaagctcacggtacgacttcgccgcgacctgccagctaaaatccattgccatagcctgacgttgcacaaaccgccacagtgaaggacgggaccacagtacaaaagcacgtcgaatagcccgtaacagcgaccaggcattactatcttcaaagacaaacccactggcgacgccatctgcaaggttctcaagagaacagtcagaaaccgtatcagcaagcccaccggtgcgccgcactaacggcagcgtaccgtacttcaatccataaagttgcgttaagccgcacggttcaaaacggctgggcaccagaatgacgtccgcgccgcccataatgcgatgcgaaaatgcttcgtgatagccaatctgaacgcccacctggccggggtattccgctgccgccgcaaggaaaccttcctgcagcaccggatcgcccgcgccgagtagcgccagctgcccgccctgctccagaagaccaggtaaggcttccagcaccaggtcgagacctttctggctggtcagacggctcaccactgcaaaaagcggcactttatcgtcaaccttaagccccattgcgatttgtaactggcgcttattttccgctttatcttccaacgtatcgcgggtgtaacgcgaggccaacagtaagtccgtctctggactccagattttctcgtccacgccgttcagtacgccggaaagacgcccttcacggtgacgctgttgcaacagaccttccataccgtaggcaaactgcggttcggtgatctcgcgagcgtaggttgggctgactgccgtaatgtgatcggcatagtacagaccggccttcaggaaagagatttgtccgttgaattccagcccatgaatattaaagaatgaccatggcaattggatgtcattcatgtgatgtgcataaaacatgccttgataggccaggttgtgcacagtaaacaccgacttcgccggacgcccgcgcgccgccagatacgcaggcgcaaggcctgcatgccagtcgtgcgcatgcaccacatcaggacgccagaatgggtcaagcccgctggccatttctgccccaacccaccccagcagcgcaaaacgcaatacgttgtcggtataggcaaataagttggtatcgtgatacgggcttcccggacgatcatagagatgcggcgcgtcaatcaggtatatgccaaccccgttgtaatgaccgaacaacagcgtgatatgtccggcgaaggtatcacgacgggatactacctgcgcatcggtcacgccacggcgaatatcgggaaatgcaggcaacagtacgcgagcgtcaacgccgtctgcgatttgtgctgcgggtaatgccccaataacatcagccagaccgccggttttaagcagcgggaacatctctgaacatacatgtaaaacctgcattatcgctcctgtttatgccctaacttccgtagcatttcgcgcgttaccagcacgatgccttcttctgaacgatagaaacgacgtgcatcttcctctgcgttttcaccaatcaccatgccttccggaataacacaagcacgatcgatgacgcagcggcgcagacggcacgagcgacctacccatacttccggtaacaatacggcggaatcaatgttgcagaatgaattcacgcgaacgcgcgagaacagaacggactgcaccaccaccgaaccggagatcacacaaccgccggataccagtgagttaagggtcatcccgtggctaccggagcgatcctgcacgaatttcgctggcggtaatgattcattgtaggtgcgaattggccaattgcgatcgtacatatccagttccggcaccacagaggccagatcgaggttcgctttccagtaagcttccagcgtacccacatcgcgccagtacggctcggcatccgggtcggattgtacgcaagagagcgggaacgggtgcgcataggccagaccggcttcggtgatcttgggaatcaaatctttgccaaagtcgtggctggagttctcatcgcgatcgtcttcttccagcagttcatacagatagtcggcgtcaaagacgtaaatacccatactcgccagagatttgctcggatcgttcggcattgacggcgggttagctggtttttcaacgaattcgataattttatcgttctcatcaaccgccataacgccaaacgcggaggcttcttcaatcggtactggcatacaagcaacggtgcaacgtgcgcctttttcgacgtggtcgataagcatacgcgagtagtcttgcttgtagatatggtcgcccgccaggatcaccacgtattccgctttataacggcggataatgtcgaggttttgggtgaccgcatctgcggtgccgcgataccagttttcccctttcattctctgctgtgctggcagcagatcgacaaactcgttcatttcttcattgaagaatgaccagccgcgctggatgtgctgcaccagagtgtgggactggtactgggtgatcacgcccatacgacggatcccggagttgatgcagttagacagcgcaaagtcgataatgcggaacttaccgccgaagtgtacggccggttttgctcgcttattggttaaatccttcaggcgggtaccacgtcctcccgccagtatcagggcaacagatttcaatggcagctggcgcgccaacattaagtgatcgttcttctctaaactaaccatgactaactccttttttatcatctctggaacacacacaatccgtgtgcaggtccctgccagacagccgtaatcactgggttatcctctccagcgaatgggggaatggcgtgccactccccagcaggtaaaacaatctctgttacctcaagcgtggcgttaattgcgatcaaaaagcgatccgagagcagaatttgcagctgtttcggcccgttttgccactcatccgtgcttaaaggttgagcatatcgatttagccaacggacattgccgtcgccttcttcccaccagcgattctccatcaaagcgggaatgcgcttgcgcagatggattaacgcggcggtaaatgcggttaaaccactgcttgcctgcgaccagtccaaccaggttaattggttatcctgacagtaggcattgttattgccatgctggctgtgaccatgttcgtcaccggccagtaacatcggcgtaccctgggagagcaacaacgttgttaacagggcgtgaatgctgtcgcgccgccgttcaaccagatcaagagtaccgcctaacccttctttaccatgattgttactgtaattgttgttggtcccgtcgcgattttcttctccgtttgcttcattgtgtttatggttgaagcaaacgcagtcgcgaagcgtaaaaccgtcatgcgcggtgacgagattaatcgcggcactcggcagacgaccattacgtttaaaaacatcgctggaggcagcaaaacgcccagcaaacactcccagaggtaaatcataatgcagccagaaacgacgggctgcatcgcggaaatgatcgttccactcggcaaacagcggcgggaaatttcccacctgataaccaccaggagcgatatcccacggttcagcaattaacttcacctgcgagagcaccgggcagttctggatagcggtaaacaacggcgcatcctgacgaaactctggcgtacggcccatgactgccgccagatcaaagcggaaaccatcgacgtggcaggtttctacccaataacgcaggcaggcgctggcataatctaccaccgccggatgactcaaattgagcgtgttaccacaaccggtccagttgtgataatcgccgtcttctcttatccaataatagctacggttgtcgatcccacgcagcgagaataacgggccgtcgaggtccagttccgcactatggttgagcacgatatcaagaatgacttcgatacccgctttatgcagtgctttgattgcatcgcgaaactcatccagcgccgtttctggcgagcaggcatacgccggatgcagcgcaaacatcgccaccgggttgtaaccccagtagttactaagccccatacgttgcagacgtggttcgctggcaaattgtgccaccggcagcagttccagcgcggtaatgcccaactgtttcaaatagttgatcatcaccggatgccccagggctttataagtgccacggatctcgaccgggatctccgggtgcagatacgttaatcctttgacatgggcttcataaatgatggtgctgccccacggcgtgcgcggcggggcatcatcctcccagtcatagtgatcaaccaccactacgcatttcggcacaatggcggcgttgtcgcgatagtcaggttcattatgaccggcgtgcagcagcgggttatctttaaactccccgtcaatttgccgcgcgcaaggatcaatcaacaacttcgccgggttaaagcgatgcccctcggcgggttgccaagggccatgaacgcgataaccataacgcaaacccgggcgcgcatccggcagataaccgtgccaaatgtcgccactgtgccctggcaagtcatagcgatgttcctggccattggcatcaaagacacacagctctacccgctcggcatgagcggagaaaagtgtgaagttgacgccctgaccgtcgtaatgcgcgccgaggggagtgggtttgccaatggcgagttgtgtcattctgcctcccgaaccagccagatagtggccagaggtggtagcgtcaggctcagcgaatgctgacgaccgtggctggcaatctcatcgctgtgtactgcgccgccattgcctgcattactgccgtgatagtgcatggaatcggtattgaggatttcacgccatttacccggctggttaataccgaagcgataatcatgacgcggcaccggtgtaaagttactggcaacgatgatttcgttaccctctttatcgcgacgcacaaagatcagcaccgagcgttctttgtcatccaccaccagccattcaaagccgtacgagtcaaaatccagttcatgcattgctttatggtggcagtaggtgtggttcagatcgcgcaccagacgctggacaccgtggtgccagttatcgccgccttccaacagatgccagtcgaggctggcgtcatggttccactcgcggccctgggcaaattcgttccccatgaacagtagtttcttgcccgggaatgcccacatccagccgtagtaggcgcgcaggttagcgaatttctgccatgcgtcgcccggcatccggtcgagaatcgattttttaccgtggaccacttcatcatgcgacaacggcaggacgaagttttcagtgtagttgtagagcatcccgaaggtcagtttatcgtgatgatactgacgataaatcgggtcgagcttcatgtagtccagggtgtcatgcatccagccgaggttccacttgtaccagaagcccagaccgcccatatcctgcggacgagaaacgccagggaaatcggtagactcctccgccattgtcactgcaccggaaacctgctcaccaagaatacggttggtattacgcaagaattcaatcgcttcaagattctcgcgaccgccaaattcgttcgggatccactccccctctttacggctgtagtcgcgataaatcattgacgccaccgcatcgacgcgcagcgcatcaataccaaaacgttcaatccagtaaagtgcgttaccgacaaggaagttactgacttcacggcgaccatagttgtagatcagcgtgttccagtcctgatgatagccttcgcgcggatcgctgtgttcatacaagttcgtgccatcaaattcggcaagcgcaaagtcatcggtcgggaagtggcctggcacccagtcgagaatcacgttcagaccagctgcgtgtgcggcatcaatgaaataacggaagtcgtcgcgagtaccaaaacggcgggtcggtgcatacaggccggttggctgataaccccaactgccatcgaagggatgctcattaatgggcagtagctcgagatgggtaaagcccatccatttagcataaggcaccagttgatcggccagctcgcggtagctcaaccagaaattgttgtcggtgtggcgacgccaggagccaaggtgaacttcataaatagagattggcgcatcaaactgattcgcttttttgcgctcttcagtctgcacaaccttttccggcagcccgcaaataagagacgcggtttccgggcgcatttgcgcttcgaaggcataagggtcggacttcagacgcaagttgccattggcatcaatcatctcgtatttatagagctgaccgttatgcgccccagggataaacagttcccagattccgctctctttacgcagtcgcatcggatgacggcgaccgtcccagtagttgaattgcccaaccaccgagacccgacgggcgtttggagcccagacagaaaaacgcgtacctgtgacgccatccatagtatctgcatgcgcgcctaaggtttcatacggacgtaggtgagtaccttcagataatagccaggcatccatttcctggattagcgggccaaaacggtaaggatcatcaatcaggttttgctgaccatgccagacaacagccaactgatagcggaaaaaattcttacgtcgcggaatgacaccgctaaagaatccccgtgagtcgagacactccagttttgcgagtttgcgcccggttttcggttcaatcacccacacatcggtagcgtcgggtaaaagggcacggacttccagtcccgcggtggttttatgcatccccagtacggaaaaaggatccgcaaaatggcctgcaattagcgcgttaatcacgtctctatcgatacgatcggacatgcttgtcttcctgttttattgtgtcaccccatccaactgaatttttgacttctggttgtgacatttttttgacctgaacggcgcagcactctgtgcatcctctctgcgtcgtcctcacttcaggtaaggctgtgaatactcgtgtattccgccacccttaaagaatagccaatgctctatttaactcccggtaaatcatgaaacatctgcgcttactcctgtattacgcactagcaggggcggcatcgcgccccagatttaatgaataaagattacgccagttgacgaagcatccgacgcagcggctccgcggccccccacagcagctggtcgcccacggtaaaggctgacaggaactccggtcccatatttagcttacgcaggcggcctaccggcgtggtcagcgtgccggtaacggcagctggggttagctcacgcatagtgatttcccgatcgttcggaacaactttcgcccacggattgtgcgcagccagcagttcttccacggtcggaatagacacatcttttttcaatttaatagtgaatgcctggctgtggcagcgcaatgccccgacacgcacacataaaccatctaccggaattacggaagatgtgttgaggatcttgttggtttccgcctgccctttccactcttcgcggctctgaccgttatcaagctgtttgtcgatccacggaatcaggctacccgccagcggcacgccaaagttatctaccggcagctcaccgctacgggttaaggttgtgactttgcgttcgatatcaagaatagcagaggacgggttcgcgagttcatctgccacatggccatacagatggcccatttgggttaataactcacgcatatgtcgcgcaccaccgccggaagcggcctggtaggttgcaacggacacccaatcaacaagatcattggcgaataaaccccccagcgacatcaacatcaggcttacggtacagttaccgccaacaaaagtcctgatgccattatttaatccgtcggtaatgacgtcctgattgacggggtcaagaatgatgatggcgtcatctttcatgcgcagagatgatgctgcgtcaatccagtaaccttgccatccgctttcacgaagctttggatagatttcgttggtataatcgccgccctgacaggtcacaatgatatcgagggcctttagcgcctccagatcaaaggcatcctgaagtgtgccagtggttccgccaaaagacggcgcagcctgaccaagctgagaagtagaaaagaagacagggcgaatggcgtcgaagtcgcgctcttcaaccatgcgttgcatgagaacggagccgaccataccgcgccagccgataaaaccaacatttttcataagcgttttttcctgcaaagatgtgtgctgtataaatgtgccggtctcctcctggcacatctttcaccatacaaaaagcagccaaagtcgcaagtgaaattaatcaatgatagcgaagccatcagtaatgcgacttatcctgctttgttagcacgcagaaaatccgcggcaattatcagggaatttgagttatgaatgaaatcatttctgcagcagttttattgatcctgattatggatccgctcggaaacctacctattttcatgtccgtactgaaacatactgaaccgaaaagacggcgggcaatcatggtgcgagagttgcttattgctctccttgtgatgctggtgttcctgtttgcgggcgagaaaattctggcatttcttagcctgcgggcagaaaccgtctccatttctggcggcatcattctgtttctgatcgccattaagatgattttccccagcgcttcaggaaatagcagcgggcttccggcaggtgaagagccgtttatcgtgccgttggcaattccgttagtcgccgggccgactattctcgccacgctgatgttgttgtctcatcagtacccgaatcagatgggacatctggtgattgctctgctgctggcctggggcggcacctttgtcatcctgctacagtcttcgctatttttacgtctgctgggcgagaaaggggtgaacgcacttgaacgcctgatgggattgattctggtgatgatggcaactcagatgttcctcgacggcattcgaatgtggatgaaggggtaacgaggagagtttttcgaaaagagcccggtagcgtcagaactaccgggtaaacaaacttaactcaacagctggaacgcaatcatcccaacgatggcaccgacagtgccgaggatggtttccatcatggtccaggttttaagcgtttcggcttcggtcgcgccggtaaatttaccgaacaaccagaaacccgcgtcgttaacgtggctgacaacaatcgaaccaccggcgatacaaatcgacagcgccgccatttgcgcaccggagtagttcagttgttcaatgaccggcattaccaatcccaccgccgttaaacaggcaacggtagcagaaccctgaatgatgcgcactgcagctgccagcacgaagcaggtgatggcaatcggcaggcccatgccggttaacgcttcgcccagtgccggaccgacaccagagtcaaccagcacctgtttgaacacgccgcccgcaccaatcaccagcagaatgatccccgccggttgcagcgcgtgaccgcaaatctccatcactttgtcttttggcataccctgacgcattgccagaccgtaaatcgccaccaggcaagcaaccagaatcgcggtaaacggatgaccaataaactcgaaccattcgtaagcagtagagccttctggcacaaaacgcgcggcaatggttttcagccccaccagcaccagtggcaacaggatcagcgacaggctgaatccgaaggacggcattttgccttcgccgagatgcggttcgctgatgtcgtcaggaatatgcaactccacgtagcggctgatgaaattaccccacagcggcccggcaataatcattcccggaattgccgcgcacaggccaatcaggatcatccagccaaagtcggcgttcatctgcgatgccagcagcattggcgctggcccaggcaccaggaacgcagccgctgccgccacgcctgcaaataatgggattaccagcttcaccaggttcgtgccggtgtggcgcgccattgagaaagcaacgctaatcagcagaacaatcgccacttcaaagaacagcggtagcgcacaaaccagccccgcaaggccgatagcataatgcacgcggctgtgaccgaaggatttgagcattttgacggcaatctgatcgaccgcgccggtttcatgtaagatcttaccaaacatggctcccagggcgacaaccaccgccaggaagccgagggtgcctcccatccctttttccatcgtcgctgcgattttatcgagcggcataccagaaaaaaggccagcccccatggacaccaccattaaagccaggaaagcgtgcatacgcgccttcatgactaaaaacagcagcagtaaaacagaccctactgctgttaaaacaagcgttaatgtagtcactacttatttgccttttttaataacctcaatggtgcttgccacaacaccttccagcggttgatcaatatccaccaccagtacatcggtttcgtccgcacccggctcctgcagcgtttcaaactgcgtcaccaacatttgggttttaaagaaatggcctttgcgcgctttcaggcggctttcaatcacatcaaaatcgcctttcaggtagatgaaagagagattaggattaccttcacgcagcaagtcgcgatagtgttttttcagtgcagaacagacgatcagcgatactttattggtgcgctgcatagcaaacgcggcgtcgttcagcgcctgcaaccacggtttgcgatcgtcgtcattcagcggttcgccagacgccattttttcgatattgcagcgcggatggaggaaatcgccatcaagaaacgcggcatgaagttgatgcgccacttcactggcgaccgcagatttgccgctgcccgatacgcccatcaagacgtaaatgtggtgatcatggttagtcgtgctcaaagtggtgcccccacaatacaagaattaaaaatgttacgggtaactgttatcggtaacattgtccaaccggacaatatcagaagcaatatccatccgtgccttaagtgtataagtgtgagctacttcaaatttgtaggcttaaatagatccgcccggtgacaaggtgaaacctaaatctaacattttcggtgtcacagattcgccacgaatacgcgccagcaggcgctcagcgccaatgctgcccatccgctcacgcggcgtcagcacactcgccagccgtggctccatcacctgaccaatgtcatgaccatggaaaccggcaatcgccatatcgtcaggaactttcaaccccagacgctgacattcaaacgccgcgccgaccgccaggtcatcattagtacagaacacgccatccagctgcggatattcccgccgcgcctggcgaatcagttcaataccggaagagtaagaagaagattgctcaaccatcacgctatacggcaccaggcctgcatccagcatcgcctgttcgtatcccttctgtttgatgatagtacgttcgtcgaggcgtgcgccgagataggcaatgtgacgatgcccgcgagcaataatggcggtggtcatctggcgtgccgcttcaaagttatcaaaaccgacggcgatatcgaggcacggcgacttactgtccatcaactccaccaccggaatccccgccacttcaatcatctttaaggtgcgtggagtgtgggtacgttcagtgaggatcaggccgtcgatattccatgagagcattgattcgaggcgttcttgctccatttccggtttataaccgtagtgcgccagcatggtttgataaccgtgcgcgtcggtgacgctttcgattccgcgtaatacttccgcgaaaacctggttggtgagagaaggtaacaggacgccaatcgcccggctggtggcattagagagtatatcgggcgcgcgattgggaatataacccagttcatcaagagcggcggcaatcttgccgcgtagagcgacggaaacctgctccgggttgcgtaaaaaacggctgaccgtcattttagtcacgcctacacggtcagccacatcctgaagtacgggtcttttctttttcatcgtcctgaaggtacaaaagagatagattctcttagtttaacacggacgcatcacaaccttcctgattcctcaggaaggtttgtgagataaatttagactggcggtaaatcgaacagcaggatttcgctgtcgctattagcatggatggaaatcgcctgctcatcccagattgccagaccatcgctggtcgaggctttcacgccgttaatggtgacattgcctttcaccacctggatccagacgcggcgttcagcggcaatctgatgcaccgactgctcatctttcaccagcgcccaacgatacagttccatatcctgatgcactttcaatgaaccatcacgcgcatccggcgaaagcaccagttgtttgccctgcacggcatcgaagcgacgctgttcataacgcggcgtaatgccgttttcttcaggcatgatccagatctgatacagatgcagacgctcggtgctgcttgggttgtactctgagtgacgaatacccgtacccgcactcataatctggaactcgcccgccggaacctgctctttattgcccatgctgtcctgatgctcaacagtaccttccagcacgtaggtcaaaatttccatatctttatgcgggtgagtgccgaagccctgccctgcttcaatcacgtcgtcgttaatcacgcgcagcgcagagaagcccataaaattcggatcgtaatagttggcaaaagagaaagtatgccaggagtccagccagccatgatttgcatgaccgcgttcatttgctttgcgtaagtagatcatttgtattcgccccctgaatgatttcgatgggcttagtgtggacccgatccgcctgggatgatagagggtgaaaattgacccctctgttcaaaaaaattgaactattcgaggggccatcaaacttacctcgcgagagtcactgcggagggagaagcttgctcaaaaccgcgttcaaggatttccagattcgtaagaacttcagattccttgacgtaatttggcgcaccgttggtgatggtttgatacaacgcatcataaacgcgcccataatcgcccatctctggcttcatctcttcccttaccgtcacgccctcgtcattgacatactccagcacaccgaccgaatcatccgctgcgaatcctggttcgcccggcataatattagccttcaggctggtttcctgctggtcgataccgtatttaataaacgaacctttcttaccgtgaacgataaatttcggataatcgattttcaccagatggctggttttgacgatggcttttagatcgccataaaacaactgcgcttcaaaggtgtcgtccggattggctttattacgcaggctgcggatgtcataagcgacgtgatccgggcgaccgaacagagaaataatctggtccatcgtatgcacaccaaggccatagaacgcgccatcctgcggtagccccggtttggtttctgccaccgggcggtaatagtcaaaatggctttccacttcgacaatctctcccagcttgccgctttcaatcgcttttttcgctgtcaggaagcaggaatcaaagcgacgattcttatacggcgtaacgatcagccctttgcttttcgccagtgcaaacagctctttcgcctgcgcaattgtcggagtgaacggtttttcgaccagcacatttttcccggcttccagcgcgcgcttcgcgtactcgaagtggctgtccgcgtgggtgcagacgacaaccagcttaacatcgggatcgtttagcacttcgtcgagatcgctggtgaaatggatatgggaataaatgggggcctgttcttccggcttcgcatggcggcgaaaaatatgcgcgacatgccagctatccttgcggttaagtacatacggcagatggtaacgggtggtgcttttgccgaagccaataaaggcgcagttaatgaccatgatttcgtcctttttaaggtggttatttacaccttagcgcaaagcggacgtggttcctactggagtgcgcataacgaacacaagcacttcccgaggataaattgagaacgaaaggtcaaaaaaaaaagccagcacccggctggctaagtaatactggaagcaatgtgagcaatgtcgtgctttcaggttctccgcgagggtcttcctgatcgcgagacaataataatcattctcattcgcacttgtccaacactttttgcaaaaaaatgcatttgactcgcatttgaaagtcaatgatgttgaaagggacatttaccccaaagaggacaaaggaatgagtgagatagtaatacgccacgcagaaacacgcgattacgaggccatcaggcagattcacgcccagccggaggtgtattacaacacgctacaggtgcctcatccttcagaacaaatgtggctggaacgactcaccgctcgccctggcatcaagcagttagtcgcctgtattgatggaatcgtcgtaggccatctcaccattgacgtgcaacaacgcccacgccgcagtcatgttgccgattttggtatctgtgtcgactcccgttggaagaaccgcggcgtcgccagcgccctgatgcgagagatgattgaaatgtgcgacaactggttgcgggtagatcgtattgagctaacggtgttcgtcgataacgcgccagcaattaaggtctataaaaaatttggctttgagattgaagggactggcaagaagtacgcgctgcgtaatggtgaatatgtcgatgcgtattatatggcgcgggtgaagtaagatagtgccctttttctgagatggaaaaagggtgtcattcaaaatcggcataccttcctttaatgtatttattttcccaataaatatatgagatttacctcataattacttcctaaagtgtaatattttattttttaatatatacgcctacaatttcctggagtaaataaataacaattaacaagcataatattgccattgataaaatagcatgccataaaaggacttttcagggatgagtaatattgtttatctgacagtaacgggagaacaacaaggaagcatctccgcaggttgtgggactactgaatctataggtaatcgctggcagagcgggcatgaggatgaaatatttacattctcactcttaaatagtattactaatacggggcttggttcacagttccatggtataacattttgtaaattaattgataaaagcactccattatttattaattccattaacaataatgaacaattgtttatggaatttgacttctatcgaataaatagatttggtagatgggaaaagtattattatatacaactaagaggcgcttttttatcggctattcatcaccagatctttgaaaaccaactggatacagaaacaataactgttagttatgaatttatcctctgccaacatcttatcactaacaccgagttcagctatttggcactccctgaaaattataaccgcttgtttttaccaaattcaaaaaacaaaacaaataatggtttaaaaacgttaaacagcgaagctgttggcaggctacttgctgctggtggcgtatacaatgggaacattgaaggattcagagatactgcggaaaaactgggtggagatgcaatcaaaggctatgatcaaatactaaatgaaaaaaacagcgggcatagcgatagcaacagcatctattcttttaacaaagcgttctaatgttgatacatatacagaaataaatagttacttaggcaaacttagaggccaacaaaaacttcttgatagtatagacataatagaaataatatacattaagagaccttcaaaagacttagctaacttacgaaaggagtttaataaaaatgtaagaaaaaattttcttatcaaacttgcaaaaacctccgaagcatctggaagattcaacgccgaagaccttttaagaatgagaaagggcaatgttcctctaaattataatgtacaccataaactatctctagatgatggtggtactaatgatttggaaaatttagtattaatcgaaaacgaaccatatcataaggtttttactaacatgcaatcacgaatagctaagggaatattagtgggtgaaagcaaaatcactccctgggccattccatctggctcaatttatcctcccatgaaaaatattatggaacccacaaaatgatgactaaaacccaaataagtaaattaaaaaaaatgatgaatgatttagactatccatttgaagcaccgctcaaggaatcatttattgaaagtataatccaaataaaatttaattctaactcaactaattgcctggagaagttatgtaatgaagttagtattctctttaataatcaacctgattatcttacttttttaagagcaatggatggattcgaagttaatggattacgattatttagcctctcgattccagaaccttcagttaaaaacctttttgccgtaaatgaattttatagagataatgatgatttcataaatcctgacttacaagaacggttagtgatcggggatgatagcatttcaatatttacttatgacattaaaagtaacttttttgaaattagagataatattggcacagaaaatatattcagttcgtttagtgatttctcttcattcttaaacgaaatcatggacagttgttcataataataaaaaggtaaccaaaatcattgtaaaccatgccatctttttagagtttaccagcagtaaatttcttgatcgaaatttatcaatacaagctatagaaaaacttacaacggaactacactccttaagtgagatggaccgaagacatgtagtcgctatttaaactgaaatagctaatggcgatgatgatcttagtgacatgttgatttggttagaattttacccgaatcataagattctgatatcttaaatgagcaaatccggttcgacgttctggaaaataaatcacaaaatattagcagatacttattttgtgactataccttatccgatgaactcttttcaaaaccagcatttaataatatctttgacgaagatgaacgcgtctttgctcaatgtataacgcaggaataataatataacgctaaacaataatatttattataattatgattacttatcacgacgcattcgcgaaagcgaacaattaccttgatgatgcaaatctcccggtcgtcattactctacatggacgctttagccagggctggtatttctgtttcgaagcacgagaatttttcgaaactggagatgaggccgcgcgcttagctggtaacgcaccttttattgttgataaaggcagtggtgaaattcattcccttggaacggcaaagccgctggaagaatatctacaggattatgaaataaaaaaggctaccttcggcttgccctgacaatacggccctcttcccacgaagagggccgctaaccttaataccccgccgttaaatcatccaccgagcgcgggtcggatgcaccgtacagctcaccgtccggcccaaccataatgctttgtgtactgcccatcgcctctttcagcgccactttctgaccttttgcttccagcagcttgatcgtatccgggctaaaccctttttcgacacgcagctcgtccggcaaccactgatggtggaaacgtggcgcattggtcgcttcggcgacgttcattccataatcgatgctattcaccaccatttgcagcacagtggtgataatccggctaccgcctgggcttccggtgaccagccaggttttaccatccttgaccacaatggttggtgacatcgacgacagagggcgtttattcggcccgacggcgttggcatcgccgcccaccagcccgtaaacgttcggtacgcctggtttggcggagaaatcatccatctggttattgagcaaaataccgctctcgcccgcgacaatgcccgtaccgaaggtggtgttcagcgtataggtcaccgccacggcgttaccgtctttatccactactgagtaatgggtagtttgattactctcataaggcgcaagcttgccaggacgaatttcgctggatggcttcgctttattgatatcgatttgatcggcaatagatttggcataggctttattggtcagcacctgccacggtactttgacaaaatccgggtcgccaagatattccgagcggccggcataggcgtatttctcagcttctgccatgatttgcatcgcgtcggcgctgccaaagccgtacttctgcatatcgaagttttccagaatattgaggatttgtacgatatgaataccgccggaagatggcggtggcatggagtaaacctgatacccgcgataatcgccgcttatcggtgtgcgttcgaccgctttatatgccgctaaatcttctttgctgatcaagccaccgtttttctgcatctcctgggcaatctgttccgctatcgtgcctttgtagaattcatccgggccgttttcggcaatcatctccaggctctttgccaggttcgcctgcaccagcttgtcgccctttttcagcggttcgccctctttccagaagatagctttgctgttttcgtggttcggcagcacttcactgccgtaggttttgagatcgtcagccagcgcgtcgttaacgataaaaccatcgcgtgccagtttaaacgccggttgcaccactttattcaacggcatggtgccgtatttatccagcgccaacgagaaacccgctaccgtaccgggtgtgccggaagccagatgcgaagtgagtgatttgttgctgtccgggttgccctgatcatcgaggaacatatcgcgggtcgctttggcgggtgccatttcgcggaaatcgatagccgtggtattgccatttttcgagcggatcagcataaaaccaccgccgcccagattccctgcctgcggatgcgttactgccagcgcgtagcccaccgccacggcagcatcaacggcattcccgccctccttgaggatatccacccccacctgagtggcagtagcatctacagacgccaccattccctgcttagcgcgtaccggatggaagacatcttcctccacaccataagaaacaggtggcgcggctaccgtactaaaacaacttcctgtgagcagagcagcaatggccacccggcgtaaaaacgtcggttttatcatcgttattctccagagattaaggggcaaccccagctaagcctggtatataactctgaattaatcatcgttttgccgggaagcgagtaaacttaaagaatatcttcagaggaggatacgcgatgaaacgacttctgcttttgacggcactcctgccgtttgtcggctttgcacagcccattaatactctgaacaaccctaaccagccgggatatcagatccccagccagcagcggatgcaaactcaaatgcagacgcagcaaatccagcaaaaagggatgctgaaccagcaactgaaaacgcaaacgcagctgcaacagcagcatttagaaaaccagataaacaataattctcagcgggtgttgcagtcacagccgggggagcgaaatcccgcccggcagcaaatgctgcccaacaccaacggcgggatgttaaacagcaaccgtaatccggatagttcgttgaatcagcagcatattctgccggagaggagaaacggcgacatgctgaatcagcccagcacgccgcagcctgacattccgttgaaaactattgggccgtaaagttcggaccaatcacgtcaatcgcatcggtacagatgcaatccacgccccagcgcagcaactctgccgcgcgctggggtttattgacggtataaaccagaatccgtaatccggcatctttcaactgcatcactcgcgctttatcgagcaacttatgattgagatgaatagagacgcagcccagtcgcgcggtcaattctcgccagtcgtcgcgccattcatcaagcaataaaccacgcggcagttccggtgctgcctgttgcgcggcttctaaagcatcaatctcaaacgatgacagcagcggcggcgtcataccggtccacagttcgcgtgccgccaacgccaccgttttgcccgttaatggtccagtgccagtggtgggtttgatttcgatattcgccatcatcccgtgttcgcggcagcgttccgccacctgcgaaagcaacggcagcggctcacctttaaacgctttgctgtaccaactgcctgcatccacgcgcagtaaatcctgccagttcagctcgcccgcaacgccccaaccgttgctggtacgttcgagattgtcgtcatggagcaggaagatctcgccatctttcgataactttgcgtcaaattcgatcatcttatgaccgtatcttgccccgacgtcgattgctgccagggtgttttccggggccagcttaccgccaccacgatgggcgacgatgcggggataaggccagttactcatactcgttgtcctgtttcaccatcaaaaagatgcagctgattttccggcagatgcagccacagcgtgctgcctgccgtcgggcgctcctgatgcgccagtcgcaccaccagcttctgttcgccccaacgtccgtgcgccaggttatctgcgccgaggatctccagcgtgtccatcaccagcggcacaccaccttctgcctgcgagcttagcgctatatgttccgggcgaatgccgagggtcattttacgcccggcatactgacggtagccaccgtttagcggcagcgtaataccaccatccagttcgaaatgcgtaccttcgttattcacgcggccagccagtaggttcatcgccgggctgccgataaaactcgccacaaacaggctggcgggcttttcgtacacttcaactggcgtgccaatctgttcggcgacgccgccgttcatcaccattactcgctgggcgagcgtcatcgcctcaacctgatcgtgggtaacatagagtgaagtcgttttcaggcgacggtgcagctgttgcagttcaagacgcatctgcacacgcaacttggcatcgaggttagagagcggctcatcaaacaggaacactgccggctcacgcacaatcgcacgccccatcgccacacgctgacgctgaccgccagatagctcacgcgggcggcgcttaagcaggccgtccagctccagaatgcgcgccgcttctttaacacgttcggcaatttgttgcttgcccatgccgcgaattttcagcccccacgccatgttctcctctacgctcatatgcggatagagcgcgtagttctggaacaccatcgcaatcccgcgatctttcggctccatttcggtgacacgcttgcggtcgatccagatatcgcccgtcgttacccgctctagtccggcaaccattcgcaataacgtcgatttcccgcagccagacggcccgaccatcacgataaattcgccatccgccacatcaagggtcagcggtttaatgacctgggttttgccatcccagcttttggttactgcctgtaatttcagtcctgccatcttatttctcactatcgaccaggccgcgcacgaaggcacgctgcatcactaaaacaatcactactggtgggatcagggttaacaacatcgccgccatcaccgagttccattccgttgtgccttcgcctgtggcgatcatccctttaatccctgccacggtggtgccgagatcaacgtcggtaataatcaacaacggccacaaatactggttccagccgtaaataaaggtgatcacaaacagcgccgccagattagttttggacagcggaaaaacgatgtcgcaaaagaaacgcattggcgacgcgccgtcgatccgcgcggcttccaccagttcatccggtagggtcataaagaactggcgaaacagaaacgtggcggtcgccgaggccatcagcggcagcgttaaacctgcgtagctgtcgagcattttcaggttggcgatgacttccaccgtcgggaagatacgcacttcaaccggcagcatcagggtgataaaaatcatccagaagaagaggttacgtagcggaaaacgaaaccagacaatggcaaatgccgagagcatcgagacggtaattttgccgagcgtaatgctgaacgccatcacaaagctgttaagcaacatccgccagaacggcgcgctattcgtgcctaccccgtttacccagatgttgtggatgttttccagcagatgtgtgccggggattagcgtcatcggtgcggcatagacttcttgtttatccagcgtcgccgcgacaaacgccacgtacagcgggaagaggatcaccgcgatcccgaggatcagcatggtatggctgaatattgtcagccacggacggttctcaatcattggtaacgcaccttgctttcaacatagcggaactgcaccaccgtcagcacgatgacgaggaacatcaacaccaccgactgcgcggcagacgaagccaaatccagtccggtaaagccttcacggtaaatcttataaatcagcgtcgtggtggcctgtactggcccgccggacgtggcggcgtcgatcaccgggaaggtgtcgaagaaggcatacaccaggttcaccaccagcaggaagaaactcaccggagcgataagcggcagcgcaatcttaaagaagcggcgaatcgggccagccccatcaatggctgcggcttcgatcaacgaacgggggatggattgcagcgcggcatagaagaacagaaagttgtagctgatttgcttccacactgaggcaaacaccaccaggaacatcgcctgaccgctgttttgcgcgtggttccagtcgtagccgaactcagcgagaaaatgggtgatcagcccgcgaccagggttaaacagaaagatccacaatacggcggcaacggcgggagccacggcatacggcagcagcatcaaagtttgatagaaacgactgccgcgcacgatgtactccaccagcgctgcgaagaacagcgataccagcaaaccgctgacggtgacaaaggtgctgaattttatcgtcgtccagaaggcgtcgagatagtagctgtcgtgaaacagcgtgacgaaattatccaggccgacaaactggctggagaaaccaaacggatcgacgctttgtagcgagtaccacaacgcttcgcccgcaggccagataaaaaagataacggtgatgatgagctgcggcgcgaccagcaaataaggcagccagcgcgagcggaacaccggacgggatgatgacattacagttaattcctgaactgtgccggatgcgcttcgcttatccggcctacacgcgatgccaggtcagataagcgaaacgcatccgacattacactgattaagacttcgtcgatttctcaaagcggcgcagtaactggttcccacgctcaacggcagtatccagcgcctgctgtggtgtcttcttaccggtccacacgctctccagctcttcatccacaatcacgcggatctgcggcatgttgcccagacgcagccctttggtgaacggcaacggtggcttgttcagcatctgacgcgtggcaatatccgctcctgggtttttctcgtaaaagccctgctcacgggtcaggtcatacgccgctttggtgattggcagatagccggttttctgatgccactcggcagcgttttctggctttgcgaggaagtcgaggaacttcgccacgccggtgtaggtttctttatctttaccctgcattacccatagactggctccgccgataatggcgttttgcggcgcgtctttcgcatcggcgtcgtaaggcatcatgcctacgccatagttaaatttggcgtactcgcgaatgttggcaagagaaccggaagaggcggtcgtcatcgcgcaatcaccgttatagaacttctcggtggattcatccttacgcccaacgtagctgaaatcgcccttcttgttcatctcttcgagcatggcgatgtgtttcacctgctccggcttgttgaactcaagcaccgcgtctgtgccgtcaaagccgttgtttttgctggcaaacggcaaaccgttccaggcgctaaagttttccagttggatccatccctgccagccgctggcgtagccgcacttcataccggaggctttcagttttgcggcatagtccgccagatcctgccaggttttcggcggctgttccgggtctaatcctgctttcttgaaggcgtctttgttgtaatagagaacgggagtcgagctgttgaacggctgggagagtaagtggccggttttgctgtcggagtaatagcctgaaaccgtcggcacaaactgcgactcatcgaattgaatccctgcctctttaaatacgtcatacaccggtttaatggctttcgacgccatcatggtggcggtgccaacttcataaacctgcaaaatagccggagcgttgccggtacgaaatgcggcaatccccgcgcttaaattctgttcgtagttgcctttataggtcggtacaattttgtaatccgggttttcggcgttaaaacgttgggccagagaatccacctctttacccagttccccttccatagaatgccagaacggaatggtcgtcactgcctgcgcatttgccattaaagccagtccgagcgccagtgctgaagctgtataacgtaacggtttcattgattatctctcttgttgtaccgaatgcgcgaattcacgcgttttatgctcgcggagtaacatgacatgctcgaattacagaaaaataactattttgttacatttttaagatagtaaggtgtcagaaagatgacaaggcggtgacggcgcgggcgagggaaaatgggagatggggcacggataagcggaaaaatagaaggtctgaatcaaactctacagattactcatcgtttcatgccggatgcggcgtaaacgccttatccggcctacaagatcgtgcaaattcaatatattgcaactcacccagtaggcctgataagcgcagcgcatcaggcaattttacatttgtcacctgtctcaaaggagtcttttgactccttatcaatcaacgtgttattacccgcctaaatacgcacttctcaccgcttcattcgccagcagcgcgtcgccggtatcggagagcactacatgaccgttttccagcacgtagccgcgatccgccagctttagcgcctggttggcgttctgctcgacaaggaagatggtcatcccctgctcgcgcagttgttcgatggtgtcgaaaatttgctggatgataatcggtgccagcccgagcgatggctcatcaagcaacaacaaacgcgggttgctcatcagcgcgcgaccaatcgccagcatctgctgttcaccgccagacatagtgcccgctcgctgaacacggcgctcatgcagacgtggaaacagttcatagacccactttatgcgctcctggaactggtcgcgttcggcaaaaaagccgcccatcgccaggttctcttccaccgtcatccgcgagaagacgcgacgcccttccgggacaatcgctaccgcttcgcgcatgattttcgccgtctgccagtcggtaatgtctttatcatcaaacacaattcgcccgctggtggcgcgcggatcgccgcataacgtgccgagcaaggtggttttccccgccccgttcgcgccaatgagggtgacaatctcgccctgattgatatgcaggctcacctcatgcagcgcctggattttgccgtagtgggcgctgactttgtcaaaggacaacatgactttttccatcttatgcctcacctaaataggcacggatcacgtccgggttattacggatctgctccggtgtaccgtttgccagcggcgtcccctgattgaccacgtaaattctgtctgaaatccccatcaccagcttcatatcgtgttcaatcaataagatagtggtgttgtgatggttacgcagttcggcaatcagctcatccagctctttcgtctctttcgggttaagacctgctgccggttcgtcgagcattaaaatctccggctgcgtcaccatacagcgggcaatctccagacggcgctggtcaccataggccaagttactcgcctgacggttggcatgttccagcaaaccaatgcgctcaagccaggtagcggcgcggtcgagcgcttcgctctgggcgcgacggaaagagggggttttcaacaggccggagaacagcccagttttcagttgctgatgctgtgccaccagcaggttttcaatcaccgtcatttcacggaacagacgtacatgctggaaggtgcgcaccacgcccatgcgggcaatttgctgccccggtaaaccttccagatgctgatcgcgcagtaaaatggtgccgccggtgggtttatagaatccggtcaggcagttgaagaccgtggtttttccggcaccgttagggccgattaacgagacgatctcctgcgggtacagttcaagattgacgttgttcaccgccagcaggccgccgaagcgcatcatcaggccgttaacagataataatggctgactcatgcctgctctccttttgctgcgccgtttttcagcttgagttgcgggcgcgtcatgggcagcaagccctgcggacgccagatcatcatcagcaccatcaaaccaccgagcattaacatgctgtattcgttgaaatcacgcatcaactcgcgcgataccaccagcaaaacagccgccagaatcactgcaaattgcgagcccataccgccgagcaccactatcgccagcacaaacgccgattcggcaaaagtgaaggattcagggctgacaaagccctggcgcgcagcaaacaacgttccagcaaaaccggcaaacgcagcgctgatggtaaaggcagtcagcttgatacgacgcgggcttaagcccagcgaacgacaagcgatttcatcttcacgcaacgcttcccacgcacgccccagcggcatccgcagcaggcggttaatgacaaacaggcttaacaccactagcagcaacgccaccagatagaggaaaatgacgcgatcggagggatcgtatttcaggccaaagaaattgctgaacgtgtcccagccgccttcgcgggcggtacggctgaactcgagtccgaagagcgtcggtttcggaatctgactgataccgttcggtccgccggtaatttcggtgttattgagcagcaatatgcgcacaatttcgccgaacccgagggtaacgatcgccagatagtcaccgcgcagacgcagcaccggaaaaccgagcaggaagcccgccgccgccgccatcaacccggcaatcggcagacaggtccagaagcccagaccgtaatagtgattgagcagcgcaaaagtgtaagcgccgatggcgtaaaagccgccgtatcccagcaccagcagaccagaaagaccaacaaccacgttcagcccgagaccgagaataatgtagatcatggtcagagtggcgatatccaccgtcccacgcgacaccataaacggccacgccaccgcaagcaccagcagcgccacgaggaacagtttctgcttcaccgtggagccatcaatcgcgggcagaataaacttcggcccggaaacgctttttagccctttctggaaagcaggtcgcaaaagctggaagaaaaagaccaccgcagtgccgataaacacccactgccaacggatgtctgaagccgtgtcgaccaccagtttggtgccatccagctccagttgcacgcccataaagacgcccgccagcacaaagaacatagcggcagagagcagcgccattgcaatatgcatcggtttcatactttctctacctccgggcgacccagaataccggtcggcatcaccagcagcaccaggatcagcagggcgaatgagaccacatctttatattccgtactcagataggcagaagagagcgcctccgcaatccccaggatcagcccgccaatcatcgcccccggaatgctgccaatcccaccgagcaccgcagcggtaaaggctttcatcccggccataaagccgatgtaggggttaattacgccgtagaactgaccgagcagcacgcccgccactgccgccatcgccgcgccaatcacaaaggtcagcgcaatcacccggtcggtgttgatgccaagcaggctcgccattttcagatcttccgcgcaggcacggcaggctcgccccatacgggaatagcgaatgaaaatcgtcagtgccagcatggcgaggaaagtaacaatccagataaccgcctgcatggtagtaatagaggcagagaagttttcgctatgacccactacccactgaccgttaaacaggctgggcagcgccacgtcgcgcgaaccttcggtcaggctgacgtagttttgcaggaagatagacatgccgattgcggaaataagcgcaatcaggcgcttagagttacgcaccgggcgataggctacccgttcgatactccagccgtaggcgctggcaatgacgattgcgccgacgaatcccgccgccaccagcagccagccggtatcaatacccatcatcatcagtgcggcgatgatcataaatgagacatagctactaatcatgtaaacctcgccgtgggcgaagttaatcatgccgataatgccgtaaaccatggtgtagccgatggctatcagcgcgtaggtactgcccagcgtgacgccgttaaacatctgctgcaagaaatacaaaaactgctcagacataaggtaacctttctaaacccgcccgtttttcacggacggtaggatgatcacttggctgccgtggatgaaccgtcggcgtgccactggaagacaccaaaatcgaatcccttaagatcgcctttttcatcccagttcagcggcccaattacggtgtttgcaccgttagcttttaaatctttcaccagcgccagcggctcatcgctgccggtacgttcaagggcagttgccagagattgcaccgccgcgtaggtgatccagacatagggcccggacggatctttcttgtcggctttcagcgcatcaacgatgccctggtttgtcggatcctggtcatagcgttttggcatggtgaccaacatgccttcagcggcatcaccggcaatgttcgacagtgacgcattaccgacaccttccggccccataaactgggttttcaggccaacggaacgggcctggcgcagcatctgccccatttccgggtagtaaccgccgtagtaaacgaagtcgatgttttcttttttcaggcgggcgatcagcgcggagaaatctttctctccagcggtaatgccgtcgaagaagacgacgttggcgttagccgctttcagcccgtcctgcaccgaacgtgccagcccttcgccatactgttgtttgtcgtgaatgatggcgatgcgctggggcttcaccgtctcaagaatgtattttgccgccgttggcccctgggaagagtccagcccggcagtacgcatgatgtattgataaccgcgttgggtcagctccggattggtcgctcccggcgagatcatcagaataccttcgtcttcatagatatctgatgcaggttgggtagaggaggaacacagatgaccaataacatatttaatgccgtcgttaacgattttgttggcgaccgcaacggcttgtttcgggtcgcaggcgtcgtcatattccacgccaaccagtttatcgcccttaattccccctttggcattaatgtctttaattgcctgacgcgcgccgttaaattccatatcgccccactgggcaatcgggccggacatcgcgccgacaacggcgactttaatatcgtcagccatagcggtgtgtgaaattgccagtgcaatcatccctgcgatgatagttttcgcattccgtttcatagtcaaaaatccccattcgtgatgttgtgttgctttgtttttatgtgttaacaaatcagactgttctttttttatactgcactgtttttgcctgtctgattaagggtttagcgcagtattttgtgatgatagcgattaaaatccctatttttcagtcgattaagaacagataatattctgaatttattgatagataaacagaaaaaagcgccgttgtcagcataaaataacggtacaaagggcagaataattcactaccattcaggggattatgctggatatttttcattctctaatgttttaactttgtaattattgctgaaaaaaaattaatcacctgccaaaagaaataaaaaagagaaagcctccgattaaattatttcgctacactggctccacttttgtgatttacacgggttccccatgaagctgaccatcattcgattagaaaactttagcgaccaggaccggattgacctgcaaaagatctggccggaatattccccttcctctttacaggttgacgataactaccgtatctacgccgcgcgttttaacgagcgcctgctcgctgccgtgcgggtaaccttaagcggcaccgagggggcactggattctctacgcgtgcgggaagtcacccgacgtcgcggtgtggggcaatatctgctggaagaggttttgcgtaacaatcctgacgtttcatgttggtggatggcggatgctggcgtggaagatcgcggcgtgatgacggcgtttatgcgagcactgggatttacggcacaacagggtggctgggagaagcattaatcgtcaagtttgatttcaaaagtgatattgcctgatgcgctacgcttatcaggcctacaatgtgtgctgcaatttactgatttctttgaatcttgtaggccggataaggcgtttacgccgcatccggcatgaagcaacgtactcgatattagcaatttggcggcaacccaaagttgccgattaatgattacttcgcatcagtcgccgtgccgttggcgtgccagtcaaacacaccgaactcaaagcctttcagatcgcctttctcatcccaggtcagcggccccatcaccgtatcaaccgagttcgctttcaggtatttagcgatctccgccggatcgtcagactgattcagccccgcttgcaaagattgcagcgcggcgtaggtggtccagacgaacgcgccgcttgggtcctgttttttcgctttgatcgcgtcaacaatgggtttgttcgccggaacctgatcgtagttcttcggcttggtcaccagcagcccttccgctgattcgcccgcaatgttagacagcgagacgttagccacgccttctggccccataaactgagttttcagccctgccgcgcgtgcctgacgcaggatttgccccatttccgggtgataaccgccgtagtaaacgaaatcgatattctctttcttcaaacgcgccaccagggtagagaaatctttttccccggcggtgatgccatcaaagaacaccacgttagcattgcctttcttcaggccgtcctgcactgcacgcgccagaccttcgccgtactgctgtttgtcgtgaacgatagcaatgcgttgcggtttcactttctcaagtatatatttcgccgccgtcggcccctggtcggagtccaggccggtggtgcgcaggatcagctgatagccacgggcggtcagctctggtgcggttgccgctggggtgatcattaaaatgccttcgtcttcgtagatgtcagacgctggctgcgttgatgaagagcagaggtgaccaatcacgtatttaatgccgtcgttaacgactttgttcgccaccgcaaccgcctgtttcgggtcacaggcatcgtcatattttacgatttgcagtttgttgcctttgataccacctttagcattgatatccgctactgcctgctctgcgccagtgaactcctggtcaccgtactgggccaccggaccggacattgcgcccacgaccgcgactttaatatcttctgccagagccatattgctgaatgccagcgcgatacatcctgccagtaacgctttacccttcatgttcatcctgagaatccccattcttctggttattacgtgtgttgtgatgttgttgttcagcactttatttcgttttatgcatgactacccgtgctttagcagcatactctgctaaaacatacccgatttttatgatattggaatagctattttgacagtttattaacaatctgagtggggattggcgttttgccggaggggaaattgattattacagaggcccaaaaaacaaaaaccccggactctcatccagggttctctgcttaatagcggaaattacgcttcaatggcagcacgcaattttttcatcgcgttcttttccagctggcgcacacgctcagcggaaacgccgtaacggtcagccagttcctgcaacgtggacttgttgtcttcgtccagccagcgcgcgcggatgatgtcctggctacgctcgtccagaccttgcatcgcgtcggtcagacggtttgccgcctgctcttcccagttatcatcttcaatgccgtcggcaaagttagatgatttatcctgcagatagagcaccggagccatcggctggctatcggaatcatcgtcggaagacaggtcaaaggtcatgtcctgtgccgccatacgcgattccatctcacgtacgtctttgctggttacgcccagttcacgggccaccatttcgacttcatcctggttaaaccagcccagacgctgcttggttttacgcaggttgaagaacagtttgcgctgcgctttggtggtcgcaactttgacgatacgccagttacgcagaacgtattcgtggatctctgctttgatccagtgaacggcgaaggagaccaggcgcacacccacttccgggttgaaacggcgcactgctttcatcaggccgatgttaccttcctgaatcaaatccgcctgtggcaggccatagcccgcataattacgagcaatatgaacaacaaaccgcaggtgagacaggatcagcgttttagctgcttccagatcgccatggtaatgcagcttttcagccagcgcccgctcctcgtcagccgacaacatcggccacgcgttagctgcccggatgtaggaatccaggttgccaactggggctaaagctaaactttgcattttgtcagtcattcaaatcctctcaatcgatatcttctggcgcttcagtggtagcaacaactgtgccagagcttaagagcaacgaggttatcattcactgttttatcagaccgtgattttatccacaagttcaatgcaagcttgtgaataaattacgcacaaaatgtgacatagagataaaataccgggaagagacaacggggtctctttccctgctacggaacccattgcagggaaagagtataacacgcttttattattcaggcgtaaagtggcgtaaatgttgtaccgtggcaagccacgctgccacccagccaatcatcgagcataccagcagcaatagcaggcattcatcgaacgataagccattgatatcaaacttcgttccgaaaacctgtgccacttccgcaaccgccgatgacaaacgcagcaccagaatttctgacaaaattagtgacaacaatgcgccagaaaatcccagcaatgcgccaccgtacaggaacggacgcaggatgaaaccatccgtcgcaccaatcagtttctgcacgttaatagaatcacggcgagcaaagatactcaggcgcacactattaccgatgacgaggaacactgccgccaccatcaatacgccgatcattgccgaaacgcgcccgaccagcccggtcaacgccgccaggcgggcaaaccagctgtcatccatccgcacttcgtcaatgccgttaatctgcgtgatacgatcacgcagcgtattcagtgactccgtcccctgaaaatcgagtttcgggatcaccaccgccactgccggaagcgggttttcttccagcatatccagcgcaccaccaaaaccagaccagttacggaactcgcccagtgcgtcttcacgagaaagataattcactttctccacgccttgctcggcctgcaactgtgccaccacgcccgcagcggcgtcatcatccagcgttttttgcagataaacagtgatttgcggtgacggataatattgcgtcgccgcctggttaacgtttttgtacaccatataacagacgctgggcagcgtcagggagatggcgataaccatcaccgttaaaaacgtggcgaacggtttgcttttcagatcctgcaatgcgccgtggaaggcatagcgtacctgttcgttgaaaacgttggttttgcgatttaccggttttggcgaggatttcgcgcgtttcggcgcgttacgaccgccgtcgccagagccgccgaccgatttacggaagcgatccagacgcccgccaaactgccgaatgtgattgattgcatcgcgcttattcatggcccacgcctccatgcaagtgaccatcgctcagggtgagcatgcgataggaacgtcgcgaaatcaggttgatgtcgtgcgttgccatcaatacggttactccaacgcggttaaactcttcaaacagacgtaaaatgccttccgacagcgcgtcgtccaggttaccagtcggttcgtccgccagcagtaccgcgggcttgttcaccaccgcgcgggcaatgccaacacgctgttgttcaccgccggaaagctgaatagggaagttcttcgctttgtccagtagcccgactttatccagcgccgccgacacccggcgacgaatgtcatcaccgctggcaccggcgataatcagcgggatcgccacgttatcatagacagtacggtccatcagtagatggtgatcctggaaaatcatgccaatctggcggcgcagaaacggaacttcacggtttttcagacgcgtgatgtcatggccgctaaaccagattttcccggcgctgggccgctcaatcccacagatcagcttcaggagggtacttttccctgcgccggaatgaccggtcagaaacgccatctcacccggctgcatatggaacgtaacgccctgcagcgcctgtctcccaccgagataagccttgctgacatgttcaaagcgaatcattgttaatcctctcgggcaaaaagtgcctctataaagtcgtccgccttaaacggacgcaaatcctcaatacgttcgccgacaccaatgtagcggatagggataccaaactggtcagccaccgagaaaattaccccgcctttcgccgtgccgtccagtttcgttagcgtgatgccggttaagccaacggcttcgtggaacagtttggcctggcttaccgcattctgcccggtgctggcatcaatagtcagcataacttcatgcggagcttcaacgtcgagtttcttcatcacgcggacgattttcttcaactcttccatcaggtgcgatttgttttgcaggcgtccggcggtatcggcaatcaggacgtcgatgttacgcgctttagcggcctgaatggcgtcgaagataacagaagcggaatcagcaccggtatgctgggcaatcaccggaatattgttgcgctgaccccagacctgaagctgttcaaccgctgccgcacggaaagtatcgcctgccgccagcatcaccgatttaccctgctgctcaaactgacgcgccagcttaccaatcgtcgtggttttacccacaccgttgacgcccaccatcaggatcacgaacggcgttttaccttcaacattcagcggctcatcgactttcgccagaatctcgcccatctcttctttcagcaggccatagagcgcctcggcatcacgaagctgcttgcgggatgcgccttctgtcagattggtgataattttacgtgtggtttccacgcccacatcggcgatcaacagctgttcttccagctcttcaaacagatcatcgtcgatttttttaccgcggaacaggctgataaatccggaaccgagattttctttggtttttaacaggctgcgtttcaggcgcgcgaagaaaccttctttggtcggtttttcctgctcctgagcgatttcttccaccggctgctcttcttctgccggagaaaccaccattaccgcctcttctgccgcttcggcagccagcgcctgtgcctccggctcttcgtcggtgatttcttctttagccgcttcttcttccgccgcttcgacaatctctacggtttccgcttcggcctgccactcttctggcgaaaccgcttcggcgttgacgtcttccggcaacggcagttcttcacgttcgatagccactggctccggcgtttcttctacgaccggttccggctgtgcaacgacttccgcttcaggctgcgctttttcactttcagcaacctgttcagtaacttccacaacgtcggcagcaaaagtttccgcctcggcttcagtatgcgcctgcggctgctcttcaacggcgtgttcagaagccttcacaggctcttgcgcctgaacgatttcttctacaactggttgttcattctgaacttctgtctctttttccggggtctgctctttttgaccaaagcccagccaggaaaaaaagccacgttttttttctttcgccatttgcgactacactcctcgctgttgcttcatggcacagcgttaacgctatgtacatagcagctaaaaaaatgatgaaatagtctatcacttaacttaattcacatcaccgcctgcaagtatgtgttatctggcggattgagcaatttatcatgaaaaaaccgaatcattccggcagcggccaaatccgcattattggcgggcagtggcgaggccgtaaactcccggttcctgatagtccaggtctgcgccccaccaccgaccgcgtacgcgaaacgttgtttaactggctggctccggtcattgttgacgcccaatgtctggattgcttcgccgggagcggcgcgctggggctggaagcgttatcgcgctacgctgcgggggccacgttgattgagatggatcgtgcggtttctcagcagttaattaagaatctggcgacactaaaagcaggcaatgcacgcgtggtgaacagcaacgcgatgtcattcctggcgcaaaaaggcacaccgcataatatcgtgtttgtcgatccaccgttccgccgtggcttgttagaagagacgataaatttactggaagataacggctggctggctgacgaagccctgatttatgtcgaaagcgaagtcgaaaacggtctgcccactgttccggcaaactggtcattacatcgggaaaaagtggcgggtcaggtggcttatcggctgtatcaacgcgaagcacaaggagaaagtgatgctgattaatattggtcgtttgttaatgctctgtgtttggggatttttaatcctcaacctggtgcatcccttcccacgcccgctgaatattttcgttaacgtggcgctgatttttaccgtgctgatgcatggtatgcagctggcgctattgaaatccactttaccgaaagatggcccgcagatgaccaccgccgaaaaggtgcggattttccttttcggcgtgtttgaactgctggtctggcagaagaaatttaaagttaaaaaataaccttattgttcgcctacaaagctgacaaagcgcgttcctttatagctcagcgtacctttatcacccactgtcagggcgtggtactgctgggcgtcgaggcgaaacgtctgctccattcctccgctttgcggtttgaagcttgcctcatagcgcatactggtgcctgccggagtcacttcctgctggcgcgaacggcgatcgttaagcggtttttcccgcttgtggctcaccaccaccagcttttgctggagcggtgccatatcattatcagctttttcccgtcgttgttgcataaaacgaaacgatgcggcgacgatgattaagccaatgataacaataaagaaaagaggtggtttactcatctttatccctcatcggaaaatgcggaaataagcataccctgccagttatggtgttgtcatccgtccaccctcgccactaaactggaaacaagaccgtaggcattccgcttacgaaaaaataacgaattcaaggaactaagatgctttggtcgtttatcgctgtctgtctttccgcatggctatctgtggatgcatcgtatcgtgggccaacctggcaacgctgggtgtttaaaccgttaacccttcttctcctgctgttgctggcctggcaagcgccgatgttcgacgccattagctatctggtgctggcggggctgtgtgcctcactgctgggcgatgcgctaaccctgttgccacgtcaacgtctgatgtacgccatcggcgcgtttttcctctcgcacctgctgtacaccatctatttcgccagtcagatgacgctctctttcttctggcctctgccgttggtgctgctggttctgggcgcgctgttactggcgattatctggacgcgtctggaagagtatcgttggcctatctgcacgtttatcggcatgacgctggtgatggtgtggctggcaggtgaactgtggttcttccgtccgaccgctccggcgctctctgcgtttgtcggcgcttcgttgctgtttatcagtaactttgtctggctgggtagtcactatcgccgacgcttccgtgcggataacgccattgccgcggcctgctactttgctggtcacttcctcatcgtccgctcgctgtatctctgataaaacttgactctggagtcgactccagagtgtatccttcggttaatgagaaaaaacttaaccggaggatgccatgtcgactcctgacaatcacggcaagaaagcccctcaatttgctgcgttcaaaccgctaactacggtacagaacaccaacgactgttgctgcggcggcgcatgttccagcacgccaactctctctgaaaacgtctccggcacccgctatagctggaaagtcagcggtatggactgcgccgcctgtgcgcgcaaagtggaaaatgccgtgcgccagcttgcaggcgtgaatcaggtacaggtgttgttcgccaccgaaaaactggtggtggatgccgacaatgacatccgggcacaagttgaatctgcggtgcaaaaagcgggctattccctgcgcgatgaacaggcctccgacgaaccacaagaatcacgcctgaaagagaatctgccgctgattacgcttatcgtgatgatggcaatcagttgggggctggagcagttcaatcatccgtttggtcaactggcgtttatcgcgaccacgctggttgggctgtacccaattgctcgtcaggcattacggctgatcaaatctggcagctacttcgccattgaaaccttaatgagcgtagccgctattggtgcgctgtttattggcgcaacggctgaagctgcgatggtgttgctgctgtttttgattggtgaacgactggaaggctgggccgccagccgcgcgcgtcagggcgttagcgcgttaatggcgctgaagccagaaaccgccacgcgtctgcgtaacggtgagcgtgaagaggtggcaataaacagcctgcggcctggcgatgtgattgaagttgcggcaggtgggcgtttgcctgccgacggtaaactgctctcaccgtttgccagttttgatgaaagtgccctgaccggagaatccattcctgtggagcgcgcgacgggcgataaagttcctgcaggcgccaccagcatagaccgtctggtaacgctggaagtgctgtcagaaccgggtgccagcgccattgaccggattctgaaactgattgaagaagccgaagagcgccgcgcacctattgagcggtttatcgaccgtttcagccgtatttacacgccagcgattatggccgtcgccctgctggtaacgctggtgccgccgctgctgtttgccgccagctggcaggagtggatttataaagggctgacgctgctgctgattggttgcccgtgtgctttagttatctccacgcccgcggcgattacctccgggctggcggcagcagcgcgtcgtggggcgttgattaaaggcggcgcggcgctggagcagctgggtcgtgttaccctggtggcgtttgataaaaccggtacgctgaccgtcggtaaaccgcgcgttaccgcgattcatccggcaacgggtattagtgaatctgaactgctgacactggcggcggcggtcgagcaaggcgcgacgcatccactggcacaggccattgtgcgcgaagcacaggttgctgaactcgccattcccaccgcccaatcacagcgggcgctggtcgggtctggcattgaagcgcaggttaacggtgagcgcgtgttgatatgcgctgccggaaaacatcctgctgatgcatttgctggtttgattaatgaactggaaagcgccgggcaaacggtagtgctggtagtacgtaatgatgacgtgctgggtgtcattgcgttgcaggataccctgcgcgccgatgctgcaactgctatcagtgaactgaacgcgctgggtgtcaaaggggtgatcctcaccggcgataatccacgcgcagcagcggcaatcgccggggaactggggctggaatttaaagcgggcctcttgccggaagataaagttaaagcggtgaccgagctgaatcaacatgcgccgctggcgatggtcggcgacggtattaacgacgcgccagcgatgaaagccgccgccattgggatcgcaatgggcagtggcacggacgtggccctggaaaccgcagatgcagcattaacccataaccacctgcgcggcctggtgcaaatgattgaactggcacgcgccactcacgccaatatccgccagaacatcaccattgcgctggggctgaaagggctcttcctcgtcaccacgctgttagggatgaccggactatggctggcagtgctggcagatacgggtgcgacggtgctggtgacggcgaatgcgttacggttattgcgcaggaaataaagaggctatcagtctacggtccaacaatgccggatgcggcgtgaacaccttatccggcctacacagagcatcgaactcgtaggcatgataagacgcgacagcgtcgcatcaggcattgtgcaccgtatcgccagatgcagcttgaacgccttatccggcctacaaaccggtttcaagcagcaacattgagcgcgatcggtcccctcgcctctctggggagagggttagggtgagggcaaaaggcggcatcgaagccaatcttcccccatcaaccgcctttacgaatcaaataacgataaggcagtccatccgtctctttagcaaccagttcgtgttccataaaggtacaaaacccaggaatatcacgggtcgtcgccggatcgtcagcaataatcagcaacgtttcacctggctgcatattgcgcactgttttgcgcaccatcattactggttccgggcagcgcaggccaagtgcgtcgagtgtgtggtcagggctggaaaagagatcggtcattttcttctcatcacataaaaaaacggcgctagtttacgccctgtgagtccgtaagcaaaccaggttaacgattgcgtgaaaatcaaccattgcattgtcaacgtaaagcagtatcatgcggcggctcgaaaaaagggtcagcacgttattatgttaaggtaacagacgtgtcgtacgtattgggttccctcaccccaatggttaatcaaaaaggtacaatatgaacgttttctcgcaaacgcaacgctataaggcgttgttctggttatcgttatttcatctgctggtgatcacctccagtaactatctggttcagcttccggtctccatttttggttttcataccacctggggcgcgtttagctttccgtttatctttctcgctactgacctgaccgtgcgtatttttggcgcgccgctggctcgtcgcatcatctttgcggtaatgatccccgcattgctgatctcctacgtcatctcatcgctgttttatatggggtcatggcaaggattcggcgcgctcgcccacttcaacctgtttgtcgcccgtatcgccaccgccagtttcatggcctacgcgctggggcagatcctcgacgtgcacgtttttaaccgcctgcgtcagagtcgtcactggtggctggcaccgacagcgtccacactgttcggtaacgtcagcgacacgctggccttcttcttcattgccttctggcgtagcccggatgcctttatggctgaacactggatggaaatcgcgctggtcgattactgtttcaaagtgttaatcagtatcgttttcttcctgccaatgtatggcgtattactcaatatgctgttgaaaagactggcagataaatccgaaatcaacgctttgcaggcgagttaaaggttcgttatcagagttgtgataagatggatgaatgagccgttatggccgtttatcgaaaggaagaagtcaatgcgcaatctggttaaatatgtcggaattggcctgctggttatggggcttgcggcctgtgatgataaagacactaacgctacggcgcagggttcggtcgcagaaagtaacgcgaccgggaatcccgtcaacctgcttgatggcaagttaagtttctcgctgccagcggatatgaccgaccagagcggtaagctgggaacgcaggccaataacatgcatgtctggtccgacgccaccgggcagaaagcagtcatcgtcatcatgggcgatgatccgaaagaagatctggcggtgctggcgaagcgtctggaagatcagcaacgtagccgcgatccgcagctgcaagtggtaaccaataaagccattgagctgaaaggtcacaaaatgcagcagttagacagcattatctccgcgaaaggccagacggcgtactcttccgttattctgggtaacgtgggtaatcaactgctaaccatgcaaattacgctgccagctgacaatcagcaaaaagcacagaccaccgcagaaaacatcattaatacgctggttattcagtaagttttaagatgatgaggcggcctcaggtatttccaccggaggccgtttttttaatcgccacgtcagtaataacgcgattgcgaccagtcccgccgccgccagataaatcaccggaacgcccgcccaactcatcaccagcccagccagtggtccggtcacgccaagcgataaatccataaatacggtgtaagttgccagcgccgccccctgattttgctgcggaaccgcttttaccgccactacgcccaatgcagggaacaccagcgaaaaccccgcccccgccagtaagacgccgattttcgccatccacggcatagttgccacgccaaccagtagcaggccgattatctcaacgctaaagcaaatcatcgccacgtttaagccgccgatacggttaatgccgttagggaataacaaacgcgtaccgacaaacgcacagctaaacagcgtcagcgcgaaagccgcaccgtcccaacctttagcgtcataaaacagcgtgataaaggtggcgataacgccaaatccggcggaagccagtgccagcgccataccgtacagccagacgcgcccaagcaccgcacgaaacggcagcggtttgcctttactggcttttaccgtcggacgcgggatcgccaacaaaatggccaccagtgccacgcccataatgattaacgctaacgcctgcaatccgccccagtgataaaacacgacacctaacggcgcacccatcgccatcgccccgtaagtgacaataccgttccacgaaatcacccgcccgatatgtagcgaaccaaccacgccaacaccccacagggtcgatcccgttccggcaaaactttgtccaatcccaaggattacgcgccccaggcacagtaataacaggctgatgacgggcagactggcggttaatcctgccgtcagatatcccagaccgctcaaaaagcagccgcataaaccgaagacgacaatcttttttggtcccagtaaatcggcgtaacgtccggcatgaggacggctcagcaaggtggcaaaatattgcaggctgataaccaaccctgcccagaatgcactaaatcccattacatcatggacatagcccggtaatacagcgagcggcaacccgatggtaaggtagctggcgaagttaaacatgacaatggagacaatgcgcaaattcaggcgcaatccgtttagcgcgggttcggctacgggttcgggcatgaggatcaccacatttttacaacagtgtttcatttttaccatgtgctgacgtgaaaatcagcagtaagaatcagaatattgctggcgtgactcccgctacacttaatacaaaaagtcacaaggaagccccaatggaaacccctcaacccgataaaacgggcatgcacattctgctcaagttggcctcgctggtagtgatcctcgcgggcattcacgcagcggcagatatcattgtgcagctattactggcgctgttttttgccatcgttctcaacccgctcgtcacctggtttattcgtcggggggtacaacgccccgttgccattacgattgtggttgtggtgatgctgatcgcactcaccgcgctggtcggcgtactggcggcatcgtttaacgaatttatctctatgctgccgaggtttaataaggagctgacgcgcaaactttttaaattgcaggagatgttgccttttcttaatttgcatatgtcgccggagcgaatactgcagcggatggactcggaaaaagtggttaccttcaccacggcgctaatgaccgggctttccggggcaatggcgagcgtgcttttgctggtgatgaccgtagtttttatgctgtttgaagtgcgccacgtcccttacaaaatgcgtttcgcgttgaataatccacagattcacatcgccggactacaccgcgcacttaaaggcgtttcgcattatctggcgttaaagacgctactcagtttatggacaggcataatcgtctggctggggctggagctgatgggggtgcagtttgcgctgatgtgggcagtactggcgtttttgctcaactacgtgcccaatatcggtgcggtaatttccgccgtaccgccaatgattcaggtgctgctgtttaatggtatttacgaatgtattctggtcggcgcattgtttttagtggtccatatggtcatcggcaatattttagaaccacggatgatgggccatcgcctggggatgtccaccatggtggtatttctttcattgttaatttggggatggctgctcggcccggtagggatgctactttcggtgccattaaccagcgtgtgtaaaatctggatggaaaccaccaaaggcggcagcaaactggcgattttactggggccaggcagaccgaaaagtcggttaccgggatgaggcgacaagtgttacgatacgcactttcattttccattaaacgttggccctgatatgtatcggatagttctggggaaagtttcgaccttaagcgcagctcctctgccaccgggtttacgcgagcaagcaccgcaaggtccacgacgtgaacgctggctggcggggcgtgcattgctttcgcacacgctttccccgctaccggagatcatctatggcgaacaaggcaaacctgcattcgcgccggaaacgccgctatggttcaacttaagccatagtggtgacgatatcgccctgctgttgagcgatgaaggcgaagtcggctgcgatatcgaagtgattcgcccgcgcgccaactggcgctggctggcgaacgccgtattcagccttggggaacatgccgagatggacgccgtgcatcctgatcagcaactggaaatgttctggcgcatctggacgcgcaaagaagccatcgttaaacagcgtggcggcagcgcctggcaaatcgtcagcgtagacagcacctataactcctcgctgtcagtcagccattgtcagctagaaaatttaagcctggcgatctgcacccctaccccctttacgctcaccgccgacagtgtgcaatggatcgattcagttaactgatccgcccacccgactgcccatctattgatccagaacaggtaatcagtatgacgaatacttaaaatcgtcatacttatttccgccatctattttaatccattggggttaccatgttctctacactccgccgcactctatttgcgctgctggcttgtgcgtcttttatcgtccatgccgctgcaccagatgaaatcaccaccgcctggccggtgaatgtcgggccactaaacccgcacctttacacgcctaaccaaatgttcgcccagagcatggtttatgaaccgctggtgaaatatcaggcagacggttcggtgatcccgtggctggcaaaaagctggactcattcagaagatggtaaaacctggaccttcaccctgcgtgatgacgtgaaattctccaacggcgaaccgtttgatgcagaggcggcggcagaaaacttccgtgcagtgctcgataaccgtcaacgtcacgcctggctggagctggcaaaccagattgttgatgtcaaagcactcagcaaaaacgagctgcaaatcaccctgaaaagcgcctactatcctttcctgcaagaactggccctgccccgtcctttccgttttatcgcaccctcgcagtttaaaaaccacgaaaccatgaacggaattaaagcgccgattggcaccgggccgtgggttttacaggaatcgaaactgaatcagtacgatgtcttcgtccgtaacgaaaactactggggcgaaaagccagcgattaaaaagatcacctttaacgtgatcccggacccgactacccgcgcggtggcgtttgaaactggcgatatcgacctgctgtacggaaacgaagggttattaccgctcgataccttcgcccgctttagccagaacccggcttaccacactcaactgtcacagccgatcgaaaccgtgatgctggcgctcaataccgccaaagcccccaccaacgagctggcagtacgtgaagctcttaattacgcggtgaacaaaaaatcgctgattgataacgcgttgtatggtacccagcaggtcgccgacaccctgtttgccccttctgtgccctacgccaacctcggcctgaaaccgcgccagtacgatccgcagaaagcgaaagcgttgctggaaaaagccggttggacgctgcctgcaggcaaagacatccgcgagaaaaatggtcagccgctgcgcattgaactgtcgttcatcggcaccgatgcgttaagcaaatcgatggcggaaatcattcaggctgatatgcgccagattggcgcagatgtctcgctgattggcgaagaagagagcagtatctatgctcgtcagcgcgacggtcgttttggcatgattttccaccgcacctggggcgcgccatacgatccacacgccttcctgagttcaatgcgcgtaccgtcgcacgctgacttccaggcacagcaaggtttagccgacaagccgctgattgataaagagatcggcgaagtgctggcgacccatgacgaaacgcaacgtcaggcgctgtatcgcgacattctgacccgtctgcatgacgaggcggtttatctgcctatcagttacatctcaatgatggtggtttcaaaaccggaactgggtaacatcccctacgcgccgatcgccaccgaaatcccgttcgaacagattaaaccggtgaaaccttaatgttgcgttatgtattacgccgctttctgctgctgatcccgatggtgctcgccgcctcggtgatcatttttttgatgctgcgcctcggcaccggtgacccggcgctcgattatctccgtctgtctaacctgccgccgacgccggagatgctggcctctactcgaactatgctggggctggatcagccgctgtacgtccagtatggtacctggttgtggaaggcgctgcatcttgactttggtatctcattcgccagccaacgcccggtgctggacgatatgctgaatttcctgcccgccacgctggaacttgcaggtgcggcgctggtattaattctgctcacctccgtaccgctcggtatctgggcggcgcgccatcgcgatcgtctgccggatttcgccgtccgtttcatcgcgtttctcggcgtgtcgatgcctaacttctggctggcgtttttactggtgatggcgttttcggtgtatctgcaatggctacccgcaatgggttacggcggctggcagcacatcattttgcctgcggtatccatcgcctttatgtcgctggcgattaacgcgcgtttgctgcgcgccagtatgctggacgtcgccggtcagcgtcacgtcacctgggcacgactgcgtggtctgagcgacaaacagaccgaacgccgccatattctgcgcaatgcctcgctgccgatgatcactgccgtggggatgcacattggcgaactgattggcgggacgatgattatcgaaaacatctttgcctggccgggcgtcgggcgctatgcggtgtcggcgatttttaaccgtgactatccggtgatccagtgctttacgctgatgatggtggtggtttttgtggtctgtaatttgattgtcgatttgctcaacgccgcgctggacccgcgtattcgtcgtcatgaaggagcgcacgcgtgaactttttcctctcctcccgctggtcggttcgcctggcgctgatcattatcgccctgctggcgctgattgcgctcaccagccagtggtggctgccgtatgaccctcaggctattgatttgccgtcgcgcctgctctcgccggatgcgcagcactggctgggcaccgatcatttagggcgcgatattttctcgcggctgatggcagcgacccgcgtgtcgctcggctcggtaatggcctgcctgctgttggtgctgacattagggctgattattggcggcagcgccgggctgattggcgggcgcgttgatcaggccaccatgcgcgtcgcggatatgtttatgaccttcccaacctcgattctgtcgttctttatggtcggcgtgcttggcaccgggttgaccaacgtaattatcgctatcgccctttcgcactgggcatggtacgcgcgcatggtgcgcagtctggtgatttcactgcgccagcgcgagtttgtgctggcatcacggctttctggcgcgggccatgtgcgggtgtttgttgatcatctggcaggtgcggtgatcccctcgctgctggtgctggcgacgctggatatcggtcatatgatgctacacgtcgcggggatgtccttcctcggtctcggcgtgaccgcgccgaccgccgaatggggcgtgatgattaacgacgcgcgtcagtatatctggacccagccgctgcaaatgttctggccggggctggcgctgtttatcagcgtgatggcctttaacctggtgggtgacgcactgcgcgatcatctggaccctcatctggtgacggagcacgcacactaatgccacaacagattgaactccgtaatatcgcgctacaggccgcgcagccgctggtgcacggcgtatcgttaaccctgcaacgtgggcgtgtgctggcgttagtcggcggtagtggcagcgggaagtcgctgacctgcgccgcgacgctgggcattctgcctgctggcgttcgccagacggcgggggaaattttggccgatggaaaaccggtttctccctgcgccctgcgcggcatcaaaattgccaccatcatgcagaacccgcgcagcgcctttaatccgctgcacaccatgcacactcacgcgcgtgaaacctgcctggcgctggggaaacccgccgacgacgctacgcttaccgctgccatagaagcggtggggctggaaaacgccgtgcgcgtgctgaagctctacccgttcgagatgagcggcggcatgttgcagcgcatgatgattgcgatggcagtgctgtgcgaatcaccgtttatcatcgccgatgaaccaaccaccgacctcgacgtagtagcacaagcacgcatcctcgatctactggaaagcattatgcaaaaacaagcaccgggaatgctgctggttacccatgatatgggcgtggtagcgcgtctggcagacgatgtggcggtaatgtctcacggtaagattgttgaacagggcgatgtagaaacgctgtttaacgcccccaaacatgcggtaacgcgcagcctggtttccgctcatctcgccctctacggtatggagctggcatcatgactttacttaacgtctccgacctttcccatcactatgcgcacggtggatttagcggcaaacatcagcaccaggcggtgctgaataacgtttccctggccctgaaaagcggtgaaaccgtcgccctgctgggacgcagcggctgcggaaaaagtaccctcgcgcggctgctggtagggttagagtcgccctcacagggaaatattagctggcgcggcgaaccgttggcgaagctcaatcgcgcgcaacgtaaagcgttccgccgtgatattcaaatggtgtttcaggactccatcagcgccgtgaatccgcgcaaaaccgtgcgcgagatcctgcgtgaaccgatgcgccacctgctatcgctgaaaaaagccgaacaactggcgcgcgccagtgaaatgctgaaggcggtcgatctcgacgacagcgtgctcgacaaacgcccaccgcagttaagcggcggccagctccagcgtgtctgcctggcacgcgcgctggcggtcgaaccgaaactgctgattctggatgaagcggtttcgaaccttgatctcgtgttacaggcgggcgtcattcgcctgctgaaaaagctgcaacaacagtttggcaccgcctgcctgttcatcacccacgacttacgcctggtggaacgcttctgtcagcgggtgatggtgatggacaacggacaaatcgtcgaaacccaggtggtgggagataaattaaccttttcctctgacgccggacgtgtgctacaaaacgcggtattacccgcattccccgtgcgccgtcgcaccacagaaaaggtttaacgcaaatgcaacgagtcaccatcacgcttgatgacgatttactggagacgctggacagtctgagccagcgtcgtggttataacaaccgttccgaggcgatccgcgatattctgcgtagcgctctggcgcaggaagccactcaacaacacggcacacaaggtttcgcggtgctgtcgtatgtgtatgaacacgaaaaacgcgacttagccagccgtattgtctccacccagcatcatcaccacgatctctcagttgctactctgcatgtgcacattaatcacgacgactgtctggaaatcgccgtgttgaaaggtgacatgggcgacgtgcagcattttgccgatgacgtcatcgcccagcgcggcgtgcggcacgggcatttgcagtgcctgccgaaggaagattaaccccgtaatcacgccattgtcccaatcgtcttcctgaatcgcagcagtgcgatggtgaaaaacgcgccgccaatcgctatcagcgtcaggaactgcggccagacgatttcgaatccggcaccacggtagaggatggcctgcgcgaggctaacaaagtgtgtcgtcggcatggtcagcataatgtcctgcaccatctgcggcatactttcgcgcggcgtggaaccaccggaaagcatttgcagcggcagcagcaccagaatcaccagcagccccagttgcggcattgaacgcgctatcgtccccataaaaatgccgattgacgtggtggcaaacaaactgagcgccacgcccagcataaacagcgggatcgagccttcaatcggtacgcccagcacgcctttcaccatcagcaccagcgataatcccgacaccaccagcaccaccagccccatcgaccagacctttgccatcatgatctcaaacggcgttatcggcatcactagtaagtgttccaccgtgccgtgttcacgctcgcggatcagcgccgatccggtcaatacaatcgccagcatggtaatgttgttgatgatcgccatcaccccgccaaaccacgcgggatcaaggttcgggttaaagcgcatccgtgtttccagcgataccaacggttcgctgttatcacggtagcgcgcgacaaagctgttcacttcaccgttgataatattctggatatacccattgccggtaaatgcctggctcatgcgcgtggcatcaacgttcacctgaatatccggctggcgtccagcgaggacatcacgctgaaaattaggcggaatatttatcgcgaaggtataacgtccggcgtccagcccggcatccatctcatcggcggtgatcatctccggtggcaaaaaccacgggcgatagaagctgttaacgatccggttcgataactgcgattgatccatatcggcaatggcgatcggcgcgaggttcaacgatcctggcgtaacggtcgctgacgaatacaccgacaccgtaaacgagaagacaatcagcgtcagcatcgctttatcaccgagcagactgcgcaactctttgatacccagattaaaaatattacgtaaatggcgcatcatccctcctgttttttcagcagcaggatgcttaagcccatcaccagcgggatggctatcagcaacgggataaaaagttgccacaaatcagtcagatccagcgctttcgagaacgttccgcgggcgatagtcagaaaatgactggtcgggtaaacctcgccgatccaacgtcctggaccttccagcgaagctaccggatcgatcatcccggaaaactgtgtcgccgggatcaacgtgataattgccgtaccgaaaatggcggcaatctggcttttcataaaggtggagatcagcagccccattccggtggcgatgatgatatacagcagcgccgccagggtgagagtcaggaaactgcctttatgcggtacgccaaatacaaataccgacagggcgcagagcaggaaaaagttcagcatccccagcgcgatgtatggcagctgtttgccaagtaaaaattcgctacgggtggtgggggtcacgtaaaggttgataatcgaccctagctctttttcccgcaccacgctaagggcgcttagcattgacgggatcatcatcagcagaagcgggatcaccgccggaacaatcgccggcaggctttttacgtccgggttatagcgatagcgcgtctcaatattcatcagcccgctttggctggcgggtgtggactgtcggctcgccacatcctgtagccagctctggtgcatggcctgcacgtagccttttaccgtttcggcgcggctcggcatcgcaccgtcgatccagacaccgagttccacgggcgtaccacgcgcgatatcgcgcccgaaattaggagggatctcaattgccaccgtgatatcgcccgcacgcatccgacgatcaagctcgtcataactggtgagcggcggctgttcgataaagtaacgggaaccggagagattgagcgtccacgcctggctactgacggtttgatcgcggtcaagcaccgcaaagcgcaggttttccacatccatactgatgccgtaacccattatcagcatcaggatcaccgttcccatcagcgccagcgtcgaacgtaccggatcgcgtcgcaattccagcgcttcgcggcggctgtagctaaacagacggcgcaggctgaatccctgacgtggcgcgtgggtggtgtcgtgtaccaccggcggcgcttcagcttcgttgctctgccctgccgcttcctgcaaataagcgataaatgcctcttccagactggcggctccgcgtttctcaaccagttccggcggtgtaccgctggcgagcacttttccggcgtgcatcagtgagatacggtcacaacgttccgcttcgttcataaagtgggtggagatgaagatagtcactttgtcctggcgcgagagatccaccatcaactgccagaacatatccctcgccaccggatcgacgccagaagtcggttcatcaaggattaacatctccgggcgatgaatcaccgccaccgccagcgatagccgctggcgaatgccgagcggcaatgactccggcaatacatcttcgacgtcgttgagcttaaaacgctcgctcatttcagccactcgcgcgggaatttccgcttccgggatatgaaacagacgagcatgtaactccaggttttgccgcacggtgagttcgttatagagcgaaaacgcctgcgacatatagcccacccggcgacgagtatcgatatcttttggatcaaccggttgcccgaacagccacgcctcaccttcgctggcgggcagcagtccggtgagcattttcatggtggtggatttaccgcagccgttcgaaccgaggaaaccaaaaatctccccgcgtggaatgcgaaaattgacgtgatcaacggcgacaaaggaaccaaaacgcatggtcagatcgcgcgcttcgatggcaatctctgcgttttcagggtgatacggtgggatcactaccgcctgatgcgcctggcgttgcgcttgcggtaacagatttataaatgcttcttccagcgtggcgctttgcgtttgctgccgcagctcttcggcgctgccagttgccagcacttttccggcattcatcgctaccagccagtcgaagcgttcggcctcttccatgtaggcggtggcaaccagcacgctcatattgctctgccgctggcgaatgctgtcgatcagatcccagaactgggcgcgggaaagcgggtcaacccccgttgttggttcatcaagaatcaacaattccgggtcgtggattaacgcacagcacagcccaagtttttgcttcatcccgccggagagtttccctgccggacgatcgcgaaacggtgctaatccggtgctggtcagcagctcattaatacgcacttcccgctccgctttgtcgtgaccgaacaggcgggcgaaaaaatcgacgttttcatacaccgacaaggtgtggtagagatttttgcccagcccctgcggcatccaggcaatgcgcgggcagacgtcgcggcgatgcttcgggtcgcgcatatcgccgcccagcaccatcacgccgccctgctcaatgacgcgggcaccggaaatcaacgacaacaagctcgatttaccgacaccatccggtccaatcagcccgaccatgcaacgggccggaatatcgagtgtgatattgttcagcgcaacggtttttccataatgctggctcacgcccgccagttgcgcgacaggcgggacgggaaccagttccagatgcgtcattgcggcaacctcaccaccaggtcgtcaggccacggaagttcttcattcacccgcacccacgctacgcccggcaatccggttttgacatattccagatgctgctggagtaattccggtgggatacgcgctttgacacggaacatcaatttcagccgctcatcgctggtttcgacagtttttggcgtgaactgggcgacgctggcgacaaaactgatggtcgcgggaatacgcagatctggtacagcatcaagaatcaaacgtgcttcaccgcccagtttcagcgtgcccgcctgttcggttggcagaaagaaggtcatatagacgtcgctgagatcgaccatattcagcacccgaccgcctgctgccagcacttcgcctggctcggcaacccgatactgcacgcgtccgtcacgcggggctttcagttcgctgtcatcgatatctgcggcaatgcgccgttcagtggcttgtgccgcttcgacgcgagtttgcgcctgaatgatattggtgcgtgccgcctctatagcggctttagaagcagaaacctgagcttttgccgattccagcgcagctcgggcgctctcagcggcggcgcggtcgtcatccaactgttgcgcagaaattgccccccattgtgccagtgagcgggaacgcgtatgacgttttgctacggagtccagttctgcctggcgttgattaaccagcgactgtgcggcacgagtttcgctttggcgttgctccagcaaagcctgcgcggcggcaacggcactttgtgcttctttgatttgcgcgatggcttccagtcgctgttcctgcaacacgcgagtatccatcttcgccagcacttcaccttctcgaacaaactggccttctttcaccagaatggtgtcgatacgcccggcaattttgctggcgatatccacttccgtcgcttcaatgcgcccattgctgacagcaaagccttccggcacacccgccgggcgcaacagccaccacgccatgacggcagccaccgccagtgccccgacaacccaccacgccagatggcgcttactcttatccataatcgacccgccataatccctgtaagcaatcgacgcgtgttacaactgccaccgaacgatgttcagcggattcttccatccgggataagaaggaaatggcaaatacgaccagcgcacagagcattgagcgccaatggggaaggcttagtgaaaacgggtagtaatgttgtcatcatcagcattcctggccgtaaatgaaacacgcatactcataagtgaaatcaattaaatactaacagttatattcatgttgtctatttgattgccatcaacttgtgatacatcgcgatgttcttccgttcgctggtgttttttccaaaaatattctgtacaggttcacagattctgttgcacaggtttccgtaacagggaaacctgatgactatcacatagcgttattatcgcctgatgtgcgaataaataccgaatataaaataatttattctgaaaagatgatagatgataaaggttcgtgggtttaataaaatattccctaaaagattcatttaaaacaacaaaataagataaagatattaattcagagtttatcttaggataaatatttatttaatagcattaactcaccgctaaaagttgatccccataacgctaaatccgattatagtgaagttactttttttaattgatggcatcttatagacatatttaactaactgaaaagacgaatcatatgtttttcgaagtgtagcagaaaatatatatggggtttaaaatgaatatatatatcggatggttgtttaaattaattcctttactgatgggtataatatgcatcgcattaggtgagtttgtattaaccggttctgggcaaagtgaatatttcgttgcagggcatgttctgatttctctttctgcgatatgtctggcattgttcactaccgcatttattattatatctcagttaactcacggcatgaataaattctacaacaggttatttcctgttattggttatgctggttctgctacaactatgatttggggatggtcactgttggcaagcaataatgtgatggcagatgaatttgtcgccggtcatgttatttttggcgttggcatgattgccgcttgtgtatcaaccgtagcggcatcttccggacattttctgttgatccccaaaaacgcctcgggcagtaagaatgacggtacgccattgcaggcctattcttcaacaatcggtaattgcttaattgccgttcccgttctgcttactctctttggtttcatttggtcagtcatactgttacgtagtgcagatatcacaccacattatgttgcaggtcacgtactaatggggttaacggcaatttgcgcttgtcttattggccttgtcgccactattgtccatcaaacgcggaatacgttctcagtgaaagaacattggctgtggtgctattgggttattttgcttggctcacttaccattatttttggtatctacgtattaatcagttcagatgcaagcgcccgcctggcccccggcattattctcatttgcctggggatgatctgctacagtattttctccaaagtgtggttgttagcgctggtatggcgacgcacctgttcgttagccaacagaatacccatgattccggtatttacctgtctgttttgtctgttccttgctgcgttcctggctgaaattgcgcaaaccgatatggcttactttattccttcgcgagttctggttggcttaggtgcagtttgttttacactgttttccatcgtttctatattagaagcgggttcagcgaaaaaataataaaaaaggcttcagataaggcgttggacgccttatctggttttattcaggttaatccctctggtatcgagagcacattttgcttcttattctgccaccaaatcctgcgcacaagcccatgcactcgaccacgcccactggaagttatagccccccagccagccggtgacgtccatcacttcgccgatgaagtacagcccaggcactttgcgcgcttccatcgtccgtgaagagagttcgttggtgtccacgccgccgagcgtcacttcggcagtgcgatagccttcagtgccgttgggttgtacgcgccagtcagtcaatgtgctaatcagtgtctgttggtcacgcacgttgagctgttttagcgagagctccgggatttgcccgagttgttgtaaccgttcaaccaaccgcttcggcagatgaaccgccagcgtgtttttcaggctttgattcggatgtgcattacgctgctcattcaggaaggtttcgaggtccacatccggtagcagattgatgctgacaaattcacccggttgccagtagctggaaatctgcaacaccgccggtccagataagccgcggtgggtgaagagtaagttctcacggaaaacggtaccgttttcagcggtaatcacggaaggcaccgccacgcccgccagcacctgtaactcttcaagcaacggtttatgcagagtgaatggcaccagacccgcacgggtcggcagcacgttgaggccaaattgttcggcaatcttataaccaaacggcgatgcacccagccccggcattgacagtccaccggtcgcaatgaccagcttttcgcaaccgacagtcatgccgttcagttcaagcgtgaagcctgtatcatccttcgccacgctcagcacttcgctacgcaatctgaaggccacattgcccttctcgcactcatccaccagcatgtcgacaatctgctgcgcggagtcatcgcagaagagctgccctaacgttttctcgtgccaggcgatgccgtgtttattgaccagatcaatgaaatcccactgggtaaaacgcgcgagtgcagacttacaaaaatgcggattctggctcagataagcgcctggttcgacataaaggttggtaaagttgcagcgcccaccgccagacatgaggattttgcgccctggttttttaccattatcgatcagcagaacccggcgtcctgcctgacctgccagcgcagaacagaacatacctgccgcaccagcgcctataataatggcatcaaacctttccacgttgcgctcctctaagaaaaaacgggcgtgaattgtaaagattcctcagtggtcgcaccagcatcaatattactaaaaggaagtatttgcctgaattatataagataattatttttggagtggaatccatacaggaggcaaatcaaaaaaagtctatatttcactttgcccgcgccgcgaaagtcactgataatgcgccgcgttcatgtcctcaaaatggcgtaacgtcctatgctacatttgtttgctggcctggatttgcataccgggctgttattattgcttgcactggcttttgtgctgttctacgaagccatcaatggtttccatgacacagccaacgccgtggcaaccgttatctatacccgcgcgatgcgttctcagctcgccgtggttatggcggcggtattcaactttttgggtgttttgctgggtggtctgagtgttgcctatgccattgtgcatatgctgccgacggatctgctgcttaatatgggatcgtctcatggccttgccatggtgttctctatgttgctggcggcgattatctggaacctgggtacctggtactttggtttacctgcatccagctctcatacgctgattggcgcgatcatcgggattggtttaaccaatgcgttgatgaccgggacgtcagtggtggatgcactcaatatcccgaaagtattaagtattttcggttctctgatcgtttcccctattgtcggcctggtgtttgctggcggtctgattttcttgctgcgtcgctactggagcggcaccaagaaacgcgcccgtatccacctgaccccagcggagcgtgaaaagaaagacggcaagaaaaagccgccgttctggacgcgtattgcgctgatcctttccgctatcggcgtggcgttttcgcacggcgcgaacgatggtcagaaaggcattggtctggttatgttggtattgattggtgtcgcaccagcaggcttcgtggtgaacatgaatgccactggctacgaaatcacccgtacccgtgatgccatcaacaacgtcgaagcttactttgagcagcatcctgcgctgctgaaacaagcgaccggtgctgatcagttagtaccggctccggaagctggcgcaacgcaacccgcggagttccattgccatccgtcgaataccattaacgcgctcaaccgcctgaaaggcatgttgactaccgatgtggaaagctacgacaagctgtcgcttgatcaacgtagccagatgcgccgcattatgctgtgcgtttctgacactatcgataaagtggtgaagatgcctggcgtgagtgctgacgatcagcgcctgttgaagaaactgaagtccgacatgcttagcaccatcgagtatgcgccggtgtggatcatcatggcggtcgcgctggcgttaggtatcggtacgatgattggctggcgtcgtgtggcaacgactatcggtgagaaaatcggtaagaaaggcatgacctacgctcaggggatgtctgcccagatgacggcggcagtgtctatcggcctggcaagttataccgggatgccggtttccactactcacgtactctcctcttctgtcgcggggacgatggtggtagatggcggcggcttacagcgtaaaaccgtaaccagtattctgatggcctgggtatttacccttccggctgcggtactgctttccggcgggctgtactggctctccttgcagttcctgtaatcgtacgcaccaaaacgagcgggtcagtttactggcccgctttttttatgcgtcattattgctgaagtgcttaatgccaaatcatcaatgcaatcaggctgaccaccaccagaccacacaatgcgctggtcagaataaactgccgacgcacccgctcacagcggcgaataaactcatcatcgtgatgatcgcgataacgttgggcatagatataccaaacgagacgcacctgtttgttgggttggccatgtgaggtaaaaaagccccctccatcaacatattgatagagcaatggatcgcagttacgcagtaccactaacaacgcgcgtagtgatgagaaatagcgcgccatgttaacaatgcaaacgacacataaagcccaaaataatgcgacggtgcttatcatacctcctccccggcgacctgcccgcggagttccaccccggggctaccgctcccgatacgctgccaatcagttaacaccaggtcctggagaaaccgcttttgtggtgaccaacatccgagcggctctatagatagtgtaggagatcaggttgttttttttccagaaggttaaccactatcaatatattcatgtcgaaaatttgtttatctaacgagtaagcaaggcggattgacggatcatccgggtcgctataaggtaaggatggtcttaacactgaatctttacggctgggttagccccgcgcacgtagttcgcaggacgcgggtgacgtaacggcacaagaaacgctagctggccagtcatcgacaactttatggaaggagtaacactatggcttataaacacattctcatcgcggtcgacctctccccggaaagcaaagttctggtagagaaagcagtctctatggctcgcccctacaatgcgaaagtttctctgatccacgtagatgtaaactactctgacctatacaccgggcttatcgatgtgaatctgggtgatatgcagaaacgcatctctgaagagacacatcatgcactgaccgagctttcaaccaatgcaggctacccaatcactgaaaccctgagcggcagcggcgatctgggccaggtactggtcgatgcaatcaagaaatacgatatggatctggtggtttgtggtcaccaccaggacttctggagcaaactgatgtcttccgcacgtcagctgatcaacaccgttcacgttgatatgctgattgttccgctgcgcgacgaagaagaataatcttccctccacgacgtgttcctgaacgcccgcatatgcgggcgttttgctttttggcgcgccttgttacctgatgcagcgtaaacgccttatctggcctgcggtctgcgtacgcaatcaaaacccctgccaatacaacatttaacaccattatattttctatcattagtgtgatcagctggttattttctgttgtaatagtgtattaatctattctccgcatcaatattaagaatctctgacagatgtaaactttttcgcgcgttatcccttacgcgttaatacttttcaggatggtattggaaggttaataaatatgaatacaacaacacccatggggatgctgcagcaacctcgcccatttttcatgatcttttttgtcgagttatgggagcgattcggctactacggcgtgcagggcgtactggcggttttcttcgttaaacagcttgggttctcgcaagagcaggcttttgtcacttttggtgcttttgctgcgctggtctatggcctcatttccattggtggctatgttggcgaccacctgctgggaaccaaacgcaccattgttctcggagcacttgtgctggcgattggctacttcatgaccggcatgtcgctacttaagcctgacctgattttcatcgccctggggactatcgctgtcggtaacggcctgtttaaagctaacccagccagcttgctttcgaagtgctacccgccgaaagatccgcggcttgatggcgcattcaccctgttctatatgtcgatcaatatcggctcgttgatagcgttatcgctggcccctgtgatcgctgataaattcggctattcagtcacctacaacctgtgcggtgcagggttaattatcgcattactggtttacatcgcctgtcgtggaatggtgaaagacattggttctgaacccgacttccggccgatgagcttcagtaaactgttgtacgtattacttggcagcgtggtgatgatcttcgtctgcgcctggctgatgcacaacgtagaagtcgccaatctggttctgattgttctctccatcgtcgtcaccatcatcttctttcgtcaggcattcaagctggataaaaccgggcgcaataaaatgtttgtcgcctttgtcctgatgctcgaagcggtggtgttttacattctctacgcccagatgccaacgtcgctgaacttctttgccatcaacaacgtgcatcatgaaattctcggcttttccatcaacccggtcagcttccaggcgcttaacccgttctgggtggtactcgccagcccaatactggcaggcatttacacgcatctgggtaacaaaggcaaagatctctcgatgccgatgaagtttactctcggcatgtttatgtgctcactgggctttttgacggctgcagcggctggaatgtggtttgcggatgcccaggggctgacatcgccatggtttatcgtgctggtgtacttattccagagcttaggtgaactgtttattagcgcccttggcctggcgatgattgctgccctggtgccgcagcatttgatgggctttattctcgggatgtggttcctgacgcaggctgccgcgttcttgctgggcggctatgtggcaacatttaccgcagtaccagacaacattaccgatccacttgagacgttgcccgtctataccaacgtgtttggtaagattggcctggttacgctgggcgttgcagtagtgatgctattgatggtgccgtggctgaaacgcatgattgcgacgccggaaagccattaattattcttgcagaaagcggggtagcgttattgctaccccgctttacttttacaccggcgttccggcgtaaatatcaaagcgatgccctttagtgactaccgcgtttggcgtggcgacattcgccagcggcggcgcatagtccggacgcttcaccaccacgcgtttggttgccagcaaccgcgcaggctccaacaatccatcggcatcaagatccggccccaccagcgactgaaacacgcgcatctcttttttcaccagcgcgcttttctgcttatgcgggaacattgggtcaagataaactacctgcggacgcggggtgatatcgctcagcgccgtcagactggaggcgtgaatcaactgcaaacgttcctgtaaccagccgccgatttccgcatccgcataaccacgcgccaggccatcgtcgagcagcgcggcaaccactggattacgctccagcatccgcacgcggcagccgaccgaagccagcacaaaggcatcgcgccctaatcctgcggtggcgtccaccacatccggcaaataatcgcctttaatgcccaccgctttcgccaccgcctctccgcgaccaccgccgaatttgcgtcggtgcgccatcgccccgccaacaaaatcaacaaagatgccgccaagtttcggctcatcacgcttgcgcagttccaggtgctccggcgttaacaccagcgccatcaggttgtcttcatcgtgctccagcccccagcgagccgccagaacagataaggcgccgtctccggcgcctgtttcatcaattaagcagattttcactgaatgttcagcccttaatgccgtaatgctccagcatcgcatccagctgtggttcacgaccacggaagcgtttgaacagctccatcggctcttctgaaccgccacggctcagaatgttgtcgaggaacgattgcccagtttcacggttgaaaatgccctcttcctcaaaacgcgagaaggcatctgccgccagcacatcggcccacaggtagctgtagtaacctgccgcataaccaccggcaaaaatgtggctgaaagcatgcgggaaacggccccatgacggagacggtactacggcaaccagtttcttgatttctgccagagtttcgaggattttcgccccctgatccggacggaactctgcatggaggcggaaatcgaacaggccgaactccagctggcgcagaataaacagcgccgcctggtaatttttcgctgccagcattttatccagaagctccttcggcagcggctcgccggtttcatagtgaccggagataaacgccagcgcctccggctcccagcaccagttttccataaactggctcggcagttcgaccgcatcccacggcaccccactgatcccggaaacaccagcggtttcaatgcgggtcagcatatggtgcaggccgtgaccgaactcgtggaacagggtgatcacttcgtcatgggtaaacagcgccggtttaccatttaccgggcggttgaagttgcaggtcagatacgcgaccggtttttgcagcgaaccgtcggctttacgcatctggcctacgcagtcatccatccacgccccgccgcgtttgttttcacgggcatacaggtcgaggtagaagctgccgcgcagttcgtcgttctcgtcatacagctcgaagaaacgtacatccggatgccagacatcaacatctttacgctctttagcggtgatgccgtaaatacgtttcaccacttcaaacaggccgttaaccgctttgttttccgggaagtacggacgcagttgttcatcgctgatgctgtagaggtgctgtttctgtttttcgctgtagtaagcgatatcccacggttgtaactcatcgacgccaaattcggctttggcgaaggcgcgcagttgcgccagctctttttcgccttgcgggcgcgcgcgttttgccagatcggttaagaaatccagcacctgctgcgggttttctgccattttagtggcaagtgatttgaaggcgtagttttcaaagcccagcagttgcgccagttcgtgacgcagcgcgaggatctcttccatcaccttgctgttgtcccacttaccggcgttcggaccttgatcggaagcacgagtgctataagcgcgatacatctcttcgcgcagggcctggttgtcgcagtaggtcattaccggcaggtagcttgggatatccagcgtcagcaaataaccttccagctctttcgcttcggcctgggcttttgccgcagccagcgcgctttctggcatccccgccagctccgcttcgtcggtaacgagtttggtccagcccatcgtcgcatcgaggacgttgttgctgtactgattgcccagttcagaaagacgggtagcaatttcgccgtaacgctgctgtttctctttcggcagaccgatgccagagagttcgaagtcgcgcagtgcgttatcaaccgcttttttctgcgccgtgttcagcgtggcgtaatgatcgccatcacgcaggtcgcgatatgccttatacagcccttcatgttgccctacccaggtgctgtattctgacagcagcggcagggtttgttcgtacgcttcacgcagttccgggctatttttcaccgagttcagatggctgaccggggagaagatacgccccagcacatcgtccacttccgccaacggctggcagagattttcccaggtgtacggtgccccttgcgctactacgcgctccacattttcgcggcagtcgttcagcgccttagtcacggctggaacgacatgttccgggagaattttagaaaacggaggcaattcaaagggagtcagtaacggattcgtcattagcgcagtcctggttaaagaggttaaggaagcgctcaacaggcgctttacataatgtttgtagcatggggttaagtgtagtgaatttcaatgagaaacgttacgctttcgcggcggcggcctcttttcggtatactgtcctgataggcttttgtgcgccccgaatacgggccgatttttacttaccggaacacctttacccatgctcagttatcgccacagctttcacgctggcaaccacgccgacgtccttaaacataccgttcagagcctgatcattgagtcgctgaaagagaaagataaaccgtttctctatctcgacacccacgcaggggccgggcgttatcagttaggcagcgaacatgccgagcgtaccggcgaatatctcgaaggcatcgcccgtatctggcagcaggacgatttgcctgcggagctggaggcgtacatcaatgtggtaaaacacttcaaccgtagcgggcagttgcgttattaccccggttcgccgttgattgctcgccagctactgcgtgaacaggacagcctgcaactgaccgaactgcacccgagcgattacccgttgctgcgttctgaatttcagaaagacagccgtgcgcgcgtcgaaaaagccgacggtttccagcagcttaaggccaagctgccgccggtttcccgccgtggtttaatccttatcgacccgccgtatgaaatgaaaaccgactatcaggcggtggtcagcgggatagcagaaggttacaaacgtttcgccactggcacttacgcattgtggtatccagtggtgctgcgccagcaaattaagcgcatgatccacgacctggaagcgaccggcattcgcaaaattctgcaaattgaactggcggtgctgccagacagcgatcgccgtggcatgaccgcttccggcatgattgtgattaacccgccgtggaagctggaacagcagatgaataacgtgctgccgtggctgcacagcaaactggttccggcaggcaccgggcacgccaccgtaagctggatcgtgccagagtaattgcagccattgctggcacctattacgtctcgcgctacaatcgcggtaatcaacgataaggacaatatgtcatgactaaacactatgattacatcgccatcggcggcggcagcggcggtatcgcctccatcaaccgcgcggctatgtacggccagaaatgcgcactgattgaagccaaagagctgggcggcacctgcgtaaatgttggctgtgtgccgaaaaaagtgatgtggcacgcggcgcaaatccgtgaagcgatccatatgtacggcccggattatggttttgataccactatcaataaattcaactgggaaacgttgatcgccagccgtaccgcctatatcgaccgtattcatacttcctatgagaacgtgctcggtaaaaataacgttgatgtaatcaaaggctttgcccgcttcgttgatgccaaaaccattgaagtcaacggcgaaaccatcacggccgatcatattctgatcgccaccggtggtcgtccgagccacccggatattccgggcgtggaatacggtattgattctgatggcttcttcgcccttccggctttgccagagcgcgtagcggttgttggcgcgggttacatcgccgttgaactggcgggcgtgattaacggcctcggtgcgaagacgcatctgtttgtgcgtaaacatgcgccgctgcgcagcttcgacccgatgatctctgaaacgctggttgaagtgatgaacgccgaaggcccgcagttgcacaccaacgccatcccgaaagcggtagtgaaaaatgccgatggtagcctgacgctggagctggaagatggtcgcagtgaaacggtggattgcctgatttgggcgattggtcgcgagcctgccaatggcaacatcaacctggaagccgctggcgttaaaaccaacgaaaaaggctatatcgtcgtcgataaatatcaaaacaccaacgttgaaggtatttacgcggtgggcgataacacgggtgcagtggaactgacaccggtggctgttgcagcaggtcgccgtctctctgaacgcctgtttaataacaagccggatgagcatctggattacagcaacattccgaccgtggtcttcagccatccgccgattggtactgttggtttaacggagccgcaggcgcgcgagcagtacggcgacgatcaggtgaaagtgtataaatcctctttcaccgcgatgtataccgccgtcaccactcaccgccagccgtgtcgcatgaaactggtatgcgttggaccggaagagaagattgtcggtattcacggcattggttttggtatggacgaaatgttgcagggcttcgcggtggcgctgaagatgggtgcaaccaaaaaagacttcgacaacacggttgccattcacccgacagcggcagaagagttcgtgacaatgcgttaaatgttaaagggctaagagtagtgtgctcttagcccttagctacgtttccgctatcagttcagaagctgaagcagaaagcggatcagttccagcagcgcaattaacgccccaagaacgatgattgctttatcaatcacccgttttctccatgcgatggagtgagaatgcatccgcttactcatccattgcctgtcacggcgcatgtctcattgttagatgtgggctatctcactccagccagagccaccaactcagggctgaacagtaaaaaaaccgacgcgaagtcggtttttttacgtcctgattcagacctcctttcaaatgaatgcccaacgcttaattcacacctacacctttctctacacttacatattcgttaaaccatatgtgtttttgacttgtccgctttggtttgtaactctggtggcgctggcgctacacctctctttcacatcgtaatgagatactgatatgagcaacattaccatttatcacaacccggcctgcggtacgtcacgtaatacgctggagatgatccgcaacagcggtacagaaccgaccattatctattatctggaaacaccaccgacgcgcgatgagctggtaaaactcattgccgatatggggattaccgtacgcgcgctgctacgtaaaaacgtcgagccgtatgaggaactgggccttgcagaagataaatttactcacgatcagttaatcgactttatgcttcagcacccgattctgattaatcgcccgattgtggtgacgccgctgggaactcgcctgtgccgcccttcagaagtcgtgctggaaattctgccagatgcgcaaaaaggcgcgttcaccaaggaagatggcgagaaagtggttgatgaggcgggtaatcgcctgaaataaagcggctatattcccccacaggttgttagaaaaatgcgctttatttatgtcggatgcgacgctggcgcgttttatccgacctacaaagttatgataattcgatgaattgtatgttatttgtaggcctgacagtcgtagcgtatcaggcgattttgctatttacacagtactccctgcgtgagattccaattatcgcgtccagcatggtgtatcagtgagctgcttagttatcagcgatacagtgcagcagtttaaagatgtactggattatgatttatcagtggtttacacaataaataatttcaacatacgttaacctattttattattacatatctaaaacatcacaaaaatatcacttcacacactatcagagaacatcatacctttttaaaacgagcattttcgatagttgttaacgttttcttttgcgatatgattattgcctttttttgcactcaaatattaccagatggaaataaaatggaagtcaaaggtaattatatcaggaagatatgatgcattatatttactgtatgtagaagaaaatccattcctgttctaattatccaatttaaaaatcttagcataaaacaaatgatgaataaggaatgttatgtcaattgactttaccccaggtgtaataaatacatataacggtgatatttataactgcacaacaaataccgataatgttaaaacgccagacacaccgaagtggccttgtgataaccgggaagaacaacaacccattaattccccattctctggagaatggatacacctctgaacaatttgatttagcgcaacaacaacgtcaacaaattaatgcgtgccatacgaacaccacatatacaaatgcagactactcaaagttgaggctcaacttgtaagtcttattaataacattgaaacgataagctcgacaccacttccgcaaaagacacaatcaatacttaatcagataaataacattagacacgaaaagattaaaaacctctgaatatagattatggaacaatggatactcatgccacgccccaaaattaactgagctcaactaaacagaagatatataaacatcagacaggtttacgttactatcaggcatatcacctcagaatcagatgaaaactataaagaaatatctattatggttttaatatttgttgataaggatagtaacatgaacatgacaaaaggtgcactcatcctcagcctttcatttttgcttgccgcatgtagttcaattccgcaaaatatcaaaggcaataaccaacctgatattcaaaaaagttttgttgctgttcataaccagccggggttatatgttggtcaacaagcgcgctttggcgggaaggttatcaacgttatcaatggtaaaacggatacgttgttagaaatcgctgtattaccgctggatagctatgcgaagcccgatattgaagccaactatcagggccgactgctcgccagacaaagcggcttccttgatccagtgaactatcgtaatcactttgttaccatcctcggtaccattcagggtgaacaacctggctttatcaataaagtcccgtataacttcctggaagtgaatatgcagggcatccaggtgtggcatttgagagaagtggttaataccacctataacctgtgggattacggctatggtgcattctggccggaaccgggctggggggctccttactacaccaatgcggtgagtcaggtaacacctgagctggtcaaataacaccaccgaaagatgcagatgctttctcagcatctgcatcatgcattacatcaaattaatacacagtaagctaactattattataagccctgtcctgttaattacctttggcaaactgattataaagttaatgtccgtaccaggagtcggttatgtttcttataattaccagggatacgatgtttttcaccgcgatgaaaaacattctgagtaaaggtaatgtcgttcatatacagaacgaaaaagagatcgacgtaatgttgcatcagaatgccttcgtcattattgatacattaatgaataatgtatttcattctaattttctcactcaaattgaacgattaaaacctgtccatgtaattattttctccccctttaatattaaacgctgcctggggaaagtaccggtgacctttgttccgcgaactatcgccatcatcgactttgtcgcactcatcaatggcagttactgctctgtgcctgaagcggatgtgtccctctcgcgcaagcagcatcaggttctgagctgtattgcgaatcaaatgacaacggaagatattctggagaaactgaaaatatcgctaaaaacgttctactgccataaacacaatatcatgatgatcctcaatcttaagcggatcaatgagctggtacgccatcagcatattaattatctggtgtgaacgattgaacaatataaagaggcccagcaacagccagacctcccgttaattatacgttatgcagtaacgccttccggtatcaacgaagcaatttgcttacgccattgcgcttgctcctgttcaccttctgtacgttgaccataaaattgcgctatctgcgtaccatcatgggcaaacaattccaggctggttacgtggccatcgctggtcggtttacaggtaacccaggcttcagcaatgctctcttctaatagatgaagggtaaacgtcgggttgaaaatattcagccaacctttcattggcaccactttttctaccacaccggtgaaaatctgtacgcagccacggttgccaacaaacaccatgatttcattgccatcctgctgtgcagattcaagaatttgcgccaacgcactgttggatactttgcaggccaaatcgtctgccaccagattgaacgcctgttggcgcgtcaggttgtggcgcttgagcaacgtaaaaaactgatgaacgtcggtcatcgcccgccactcttgctcgaccacactggcatcggctcgcgtttgaacaactggcgcatcaacggcttttaactcaagcggcgtattctcatcggtgataaaccgtgccagaagctcactccatgccgccatatcggtattgtcggtggcataaacttttagtaatgcatcgccctgatgatcaaagaactgaatactctggcgttcgccacgagccgtgttttctttgatgtggaaaacactggcccattgattgagaaacagacgtaaatccagcgcgcgcggattgaggatcaatccggcatgtccgttcaaatgctggtttgtgaacgagccaacttgctcatggactgcatattcattacgacaaatacatttggtttcaccaacgctttccagcgccgccagaatttcacgaatatcgccgcgcatccgccacgcgtcgtgcgtgacgcgtgcaaatgccagttctgcttcgctgatattcattaaacctgcgatgtcacgcgcgtactttccgggattttgttcttttaactcaagccagcgtgtgtagtggttcattgtctctcttccttccagataaatgccccgaaatatcggggcagatgattaccattgataactcacgaaaatttttccgttacgaccatcctgtgggatgccttgcggcgaccagtactctttatcgaaggcgttgcccaataccagagtagtggtcatgcctttgagcgcctgctgcccttgataactgacgtagaaatcattcacaccatagccaggttgtttgctgtagctgctgctgatatgtgttgagcgatcggcaaacgtaccgacccaaccaacagagaagccactgtgagcgatcggaatattcagggtactggtaacggtatccgggttaatgctggagatatattccccggtatcggtgtctttgccgcgggtacggttataggccacatcaaggctaaacagatcagtggtatatttcgtcatcacatcccagccccagattttggcgttcgggacgttatacgacatagttgtcgccgccgcgaaatcgacggtcgtggagatataatctttcgctttggtatcaaagtagctggctttaaattccagagcatcattggacaacatcaggtcatcaaaacgcagcccaaaaccgtactcctgagtttcgttagtttccggacgtaagttcgggtttggcacccaatagttggtatagaagcgaccaatcgagaagtgtttagaatcgttatacatttcgcccatcgtcggggcgcggaatgcctgagcatatgagccaaataacatcagccagttggtcgggttgatagtcatccccgcacgagatgaccatttgtcggcatcaacatctttgtagccgtcgctgctaccgcgataactgtcatagcgggttccgccaagcagggtaatcggcagatcgcgtaaggtgatctcatcttgtagccagccagagctaaaatcgatttttgcttgcgggaagcccgtcgtcgcgccacccggatgttgttcctgacgataatactcaccgccatatgtcagtaagtgagaagcgaaactgtcggcaaatagagtggaacggttctccagccttgctccttttgttatctgttcacgatactcgccggaactccccgtgttttgcgcattaatacggacttccgaccagtaaatttttgcatctgcatttaaccagtcgttaccctgcggggcgagtttataagaaagctgcgcatcgcgttgaattgttgaacgatcgaccatcgggttactgctatcagaagcttcaacggtctgcggattttttggttcacgcgcgtcgttgttgtagtaacgcactaaaccgctcagagactgggctgaatcaatttgccaggtccctttcgccagcatgttattaatggattcgtcattcggcgcggtttcaccattgctctggcgtaaatcaccccgatcgcgactggaccaggccacaataccatccagattttcagttcgcccaaacgcgctcgcgcctaatcccaggctatggtcccccgtgccgccagtaccaaagacacgaaaaccactgctttgtccttcctgcaataaatcttttgcatcgaccgtatcgtaggagatcactccacccagcgcgccactgccatacagtaatgctgaaggtccgcgaacaatctcaacacgcttgatcagcgccggatcgagaaaagtgccattcaggtgtccggtatccgttccctagcgaacaccatcgacaagaaccagcacgccgcgatgatcatagccacgcatatttacatcctgaccgttggttcgtccggtaccatcaagagtaattccaggaacatgacgcagcaaatcagtggctgaagtagcagtttgattttcaggagcggaagtgtcgataacgctgaccatcataggcgcttcgaaggaactacgtgcattccccgttgccgtaacggtcatggtttcagtagcaaaagaaaacgttggcaaggtggcagaaacagccaaagccaacaaactcaaacgcaacgaggtaaattgcggacgtgacatagcgattctccatgaggaaaataaaaaatgctggctacctgggttaataccggggtggctggcgaaaaataaatttatttacaattcaaatgattagatatcaccacgggaagctattagcgtatatatcccgtaaaattgccgaatatttctgataattcagcaaaagcacgccttctttgtcaggcaaagtagtacgccacgtctgaagtgaagagtgctgtgcgttttcccttacaaaagatatgattttgttatccatgatgtcatattttgttaaactcaaacatgataatgagaattattatcgatcaattttttatgatcaagctttttttaaccgccattaacacaataaacagggggttatgaaatctatccagcatccagaaaaccatcctgtgtttatggctatccccccacaacctcatcacaaaacgttgccgttaacagtgataattttctcttctctttgctctgcaagccgcgatatctccgggttctcagctttttcccgcgctgaaatttaatcggtaacaagaacattagctgacgaagcatcttgataaaaatcaaaaataaatacgcttgtaacgccgtgcgtattgaatcgacggttgtatttcatatataactcaaatgataatcatgatcattctcaatttgataagagttctcacattataccaaggatcatcaccaggccgtttcttttttccccactaacgttatgtatttcagccgtggtctctgccgcgaagaccatggtaaaacgaaaaaaattgtttacggcattactggctcttagctggacttttagcgtaacggctgccgaacgtatcgtggtcgcaggaggatcgctgacggagctaatctacgcgatgggcgctggcaaccgcgtggttggtgtcgatgaaacgacatcttatccaccagaaaccgccaaactgccgcatattggttactggaaacaactcagcagcgaaggcattttgtcacttcgcccggatagcgtaattacctggcaggatgcaggaccgcaaattgtgctcgatcagctgcgggcgcaaaaagtcaacgtcatcactctgccgcgtgtaccagccccccttgagcagatgtacgccaacattcgccaactggcaaaaacgttacaggttcctgaacaaggcgaggcgctggtgacacagatcaaccaacgcctggagcgagtacagcaaaacgtggcggccaaaaaagccccggttaaagccatgtttattctctccgcaggcggaagtgcgccacaggttgccggtaaaggcagcgtcgcggacgccattctttcgcttgccggagcagaaaacgtcgctacccaccagcagtacaaaagctacagcgcggaatcgctgattgcggctaaccctgaagtgattgtcgtcacctcacaaatggtcgatggcgatattaatcggctacgttctattgccggaattacccacactgccgcatggaaaaaccagcgcattatcaccgttgatcaaaacctgattctgggaatgggtccgcgtattgctgatgtcgttgagtctttacaccagcagctttggccgcaataaatggatttaaatcagacgaatgaacacaaataacaccctggatctcacgccacattttgctttagacggtgatcagccctttaaagacaggcgcgccatgatgccgtttcgtggggccattccggttgccaaagagcaactggcacagacctggcaagagatgatcaatcaaacggtatcaccacgtaagcgactggtttacctacacattcctttttgtgcgacacactgcacgttttgtggtttttatcagaaccgttttaatgaagatgcgtgtgctcattataccgacgccctgattcgtgaaatagaacgggaagcagacagcgtattgcatcagtcggcccccatccacgcggtctatttcggtggcggtacgccttccgcgctttcggcacacgatttggccagaatcatcaccacattacgagaaaagctgccactggcccctgattgtgaaatcactatcgaaggccgggtactgaattttgacgctgagcgaatcgatgcttgccttgatgctggagcaaaccgcttctcaattggtattcagtcgtttaacagcaaaatccgcaagaaaatggcccgcacctcggatggcccaaccgctattgcgtttatggaaagcctggtcaaacgcgaccgtgccgcggtggtctgtgacctgctgtttggtctgccgggtcaggatgcgcaaacctggggagaagatctggctattgcccgcgatatcggtctcgacggcgtcgatctctatgcgctcaatgtcctgcccaatacaccgctgggcaaagccgtggaaaatgggcgtactaccgtgccctctccggcagaacgtcgcgatctttacctgcaagggtgtgattttatggacgatgccggttggcgctgcatcagtaacagccactggggccgtaccacacgcgaacgcaatctctataacctgctgattaaacaaggtgccgattgtctggcctttggttccggagccggcggttcgattaatggttactcctggatgaacgaacgcaatcttcagacctggcatgaatccgtcgcagcaggtaaaaaaccgctgatgatgatcatgcgtaacgccgaacgtaacgcgcagtggcgtcataccttgcagtcgggcattgaaacggcgcgtgtaccgctggacgaacttacgccacatgccgaaaaactcgcgccgttactggcccagtggcaccaaaaaggcttaagccgcgatgcgtcaacgtgtctgcggttgaccaatgaaggtcgtttctgggcaagcaacattttgcagtctcttaatgaactgattcaggtacttaatgcgccagcaattgcgcttgaaaaaccataacaggagtgatttatgagccatgtctcgttacaggaatttttgaaaacggagccagacggtacgctggaggcgatcgccgaacaatacaacaccacgctgctggaggtagtgaaaaatctgccctctccgactgttgtgtcaggtgataaattcgatactgtctgggataccgtctgcgaatggggcaacgtcaccacgttagtacatactaccgatgtaatactcgaatttagcggcgaactgccttcgggtttccatcgccacggctatttcaacctacgcggaaagcacggcatgtccgggcatatcaaagcagaaaactgcacgcatattgccttgatcgaacgtaaatttatgggcatggacaccgcctctattctctttttcaataaggaaggcagcgcaatgctgaaaatcttcctcggtagggatgatcatcgtcagctcctgagcgaacaagtcagcgccttccatgctctggcagtatcgttaaaggaacacgcctgatgacaccgtggctactctttggcgcaggcggaaaaggtgtgggtgccagaacgcttgaactggcgctggcggaacaacgtccggtcgttgctgtcattcgtcatgccgatgccgccacgaaactggcgcaacaaggcgtacaggtttttacaggcgacgcctgtgatgccagcgtagtcgcggctgcttgccgcgcagctggcccggatgcgcttatcatctcaacaatgggcggagctcaggattatctggcgcacagaacagtgattgatgaggccgagaaggctggcatcagtcgcatgattctggtgacctctttgggatgcggcgatagctggccgtttttatcagagcgggcaaaggctgcgtttggtcaggcggtacgggaaaaaacgctggcggaaagctggttgcaaaccagccagcttgattatgccattctccgccccggcggtctgcttgatggtgcggcaacgggcaaagcacaacggatacaaaatcaggagtgtcatggttttgttaaccgtgctgatgtcgccgcacatatccatgaactggcaaatgcgccagcacttaaccagcaggtctacagtctgattgaaccggacctgaaaccggcgtgatcccccggcgcggtatgtccgcgccgtaatgtcgtaacggagttttgcgtgctcaaggattcactctcttccgccagggtctttatggggctatcactattattgctagctctggtgctgtttggtgccagtcagggagcgttaaagatcagttttgatgccctttttgatgaggaataccgcgatatctggctcaatattcgtctaccacgggttttgctggcggtgctggtaggtgcagcgttggcaaccgcaggggtaattatgcaagggctttttcgcaacccaatggctgaccctggattacttggcgtcagtagcggttctgcattaatggttggcgttgctattgtgctgcccttctccttcccagtggtgctggtggtttatgagcaaatggtgtttgccattgccggaagtttagtggtctgcaccatcatttttctcatcacgcagcgccatcgcgatggcagcatgatgcaattattactcgccggtatcgccatcaatgccctgtgcggcgcagcgatcggcatcctgagctatatcggcgatgagcagcagctacgacaactcacattgtggatgatgggcaatcttggacaggcgcaatggccgacgttattggttgccagttcattcatcctaccggccattatcgcaacaacttgtctcgccggaacgctgaatttactgcagctcggtgatgaagaagcccactacctcggcgtgaacgtgaagcgtaaacgccagcaattactgttagtgagctcactgctcgttggtgctgccgtatcggtaagcggcattatcggctttattggcctggtgatcccgcatctgattcgcatgactaccggggcaaatcaccgctggctaatcccttgttccgccctcgccggagcctgtttattgctgatggcagacacgcttgcccgcacgctggtacagccagcagaaatgcccgtgggattattaaccagcctgcttggtggcccttattttatgtggttgattctgcgcaaccggaggatcacatgatcagcgcccagaatctggtttatagccttcaggggcggcgtctgactgataatgtctcgctgacttttcccggtggggaaattgttgccatcctcgggcctaatggtgcgggaaaatctacgctgcttcgccagctaaccggctatcttcaacctgatagcggcgaatgtcggttgtttaataagccattaaatgaatggtcgattactgaactggcgaaacaccgggccgtgatgcgtcaaaatagccacatggcgtttccattcagcgtacaagaagttatccagatggggcggcatccgcatcgtactggtaatcaggataatgaaacagcacaaataatggcgttatgtgactgtcaggcgttagcaaaccgcgactatcggcaattatccggtggtgaacaacagcgcgtgcaattagcgcgcctgctggtgcaactctgggaacctactccctcaccgaaatggttatttcttgatgaaccaacttcggcgctggatattcaccatcagcagcacttgtttcgtttattacgccagttagttcacgaacggcagttcaatgtttgctgcgtattgcacgatctaaatcttgccgcgcgttatgcagaccgtgttgtattaatgcaaaaaggaaaggttatcgcaaatggtaagccgcaggacgtattgacacagcaggcgctgacaatgctctacggcgcggatattaccgtacttaaagatcctgccaaccattcaccactgatcgtcctcgatcattaaaaccaacaggagtaccgcactggtactcctgcgaataaataactatacagattagctaattgaaacgcctttcacccctgccataccttttaataatcgcaacagatcttctatcgacgtcgtggcatgaagctggatatcaatggcgaccacttcatgatcttcattttcctgcaacgaaactaaatccgtttttattttttgctgcttaaaccagtcgagcattgataccgtattaccgttcactaatgtcagctgtaaatggtaatttttgttcatcaggcggaaggttaattgatggaagacttccagcaccagcaaggtcatcactgaaccataaatacccagttcgtacataccgctgccaataaccataccaatggcggcggtcacccagatatccgctgccgtcgtcagacctacaatattttggttacgaacgagaatgttacctgcaccgataaacccgacgcccgtcacaacctgagcagcaatacggctgggatccagtccgacgtgacctaaagacagcacgtcagcaaaaccatatttcgaaacaatcataaacagggcgcttcccatgccaattaatacatgtgtgcgtaaccctgctcctttgccgcgcatttgcctttccatgccaatagcgccacagacaattaccgcaagtataagtcgtataataaattctgctgtcatataaaaatgcaaaaaggagcagcaagatggctcaacttgctactcctttttacttgtaccttattaattcggcaagtcattagatgcttgatttttgaaggtatacaaatttttctgcgggtttttcttgcagtattcgatcactttaggaatttgagtgagatcggtttcatttaaagtaacggtatcgccacctttatatactgtttcttcatacagcatccaccacgcaactggtgtcattgcttttggattcagatcaataaattcctggcaggtcatatctttagcggattcattggctgccagcgcagattgtgcgttcaccagtgacaaagccgctacagcgcccataaaaataaacgctttacggagagatgaaatgttcattttgtaacccattcaatatagagattatatacaaacaggaggaatagctgcttttaaagaagatattccggcctgttcaatatgcaaggaaatacgatgtaacgcattcccggaattacatatctttcttaattttgtcccattcgcctttaactttatctttaaagctggcttttttatcctgagtacaagcctgaacgatagctggggttacggttgcaataccctgaacatctaaaaccgcatcttctggtttatctttgttgttcagtgcttcagcaaaaccaactgcagttggctggaaggattcgtccacagccaggaaatcttcacaggtccaggagttgaccggttttttgttatcagctgctttttgtgcatccgctgcattgctcactactggcagaagaagcagaccaccaagaataacgcctaatacttttttcatcgtaatatcctcaactataaagtgaaagagccgtcacgaatcaatttcgacactgaggttataacctggttttctgtatatgtcatgttgatggaaaatatcaaaatcagatatttttatttcaatacaatgagttacagacgcatcagatactgtaattaggaaatttttattaaatcgactgcattcttacacgcgtttttggcatagattgatagcaggggattttcttcttaattttatagggtggttctatgttatatatagataaggcaacaattttgaagtttgatctggagatgcttaaaaaacatcgcagagcaatccagtttattgccgtgctgctgtttatcgtcgggttgctgtgtatcagttttccgttcgtctctggcgacattttaagcacagtagtgggtgcattattaatctgctcgggcattgcgcttattgtcgggctattcagcaaccgcagtcataatttctggccggtattatccggtttcctcgtcgcagtcgcctatttattgatcggctatttcttcatccgcgcaccagagctgggcatttttgccattgcggcatttattgccggtttgttctgtgtggcaggggttattcgcctgatgagttggtatcgtcagcgttcaatgaaaggcagttggctacagctcgttattggtgtgctggatatcgtcattgcctggatattccttggtgctacgccgatggtgtcggtaacgctggtttccacactggtgggaattgaactgatatttagcgccgccagtctgttcagcttcgccagtttgttcgttaaaaagcaataattatccctatttccacctggatcatagtcacattaagtgactatgatccagttaatactctcttagctatacagtgtttcagttcaattacgcactatcattgaaacaattgcctgctgttgattatttcaacctactgaatttaatctgatttttttcgttccatggcaaattagccatttcaaacattatcatggctgatattttccgtggtcaggtttaatgttttaaaagtgctgtgggaaagtgaacaaagagttccgtaagcgttgatgctatgggcggttaaataagtaatccgggttcatttttttgcaactggcgttgattacattgcataaatatccgtgtctccagacgctatataaaaacctgaagacatgaatgagttatttaatcaggtaatttcaatgcgttaaaagaaagctggcaatccaattgccagcctaagtcgaaacaaggagactcgatatttaaatcggattacattttaactttagtaatattcttcagagatcacaaactggttattgataacttattcttgggcagtaatccgcaaaagttaaccttttgtttactggttacaaactgataacaaccaggaatcttacttaggatcaatatatggagtgcgtgatggataaatctgaagtattgattagtgttaatagacgtattagttcacgaagggcaaagttcttataggcgtttactatattgaacaacgattcggacaaggatgtaaataatgaaaaggatgacatgttcgaaacgataacggctaaggagcaagttatgatttttctcatgacgaaagattcttttcttttacagggcttttggcagttgaaagataatcacgaaatgataaaaatcaattccctgtcagagatcaaaaaagtaggcaataaacccttcaaggtgatcattgacacctatcacaaccatatccttgatgaagaagcgattaaattcctggagaaattagatgccgagagaattattgttttggcaccttatcacatcagtaaactaaaagctaaagcgcctatttattttgtcagccgtaaagaaagtatcaaaaatcttcttgagattacttatggtaaacacttgccccataagaattcacaactatgtttttcacataatcagttcaaaattatgcaactgattctgaaaaacaaaaatgaaagcaatatcacgtcaacgctcaacatttcgcaacaaacattaaagattcagaaattcaacattatgtacaagctgaaattaagacgtatgagcgacatcgtcaccctgggtatcacatcttatttttagtaaggacataagcaactgaaattgatggctggcatgacgagggatgcagatgctgatttcaatacccccggtgattattgaaggagagacgaaaacgactttattcccctggtatgtgtatccaccagtagaacccttcgttgcccgcatgctggcagaaactgttggcagaacggcaacattttttttgtcgttgacctcaccatgtcgatcactgtgcttgcatcccatcttactggctgacaaccccactatgccgctggtctgtaaatccctcatatctctcctcgcgcgcaatttaaagaaccgttatttctcaagaattttcagggactaaaatgaacagaagaagaaaactgttaataccgttgttattctgcggcgcgatgctcaccgcctgcgatgacaaatcggcggaaaacgccgccgccatgatgcctgaggtcggtgtcgtcacactctcccccggttcggtcaatgtgttgagcgaattgcccggtagaaccgttccttatgaagttgccgagatacgtccccaggtgggcggtattatcattaaacgcaactttatcgaaggcgataaagtgaaccagggcgattcgctgtatcagattgatcctgcgcctttacaggcagagctgaactccgccaaaggttcgctggcgaaagcgctctctaccgccagcaatgcccgcatcacctttaaccgccaggcatcgttgctgaagaccaactatgttagccgtcaggattacgacaccgcacgcacccagttgaatgaagcagaagccaatgtcaccgtcgccaaagcggctgttgaacaggcgacgatcaatctgcaatacgcgaatgtcacctcgccgattacgggcgtcagcgggaaatcgtcggtgaccgtcggcgcactcgttaccgctaatcaggcagattcgctggttaccgtacaacgtctggacccgatttatgtcgatctcacgcagtcggtgcaggatttcttgcgcatgaaagaagaggtcgccagtgggcaaatcaaacaggttcagggcagtacgccagtacagctcaatctggaaaatggtaaacgttacggccagaccggcacgctgaaattctccgacccgacggtggatgaaaccacgggctccgtgacgttacgggcgattttccccaacccaaatggtgacttgctgcctggcatgtatgtcacggcattagtggatgaaggtagccgccagaatgtattactggtgccgcaggaaggcgtcacccacaacgcccagggtaaagcaacggcactcattctggataaagacgatgtcgtgcagctacgcgaaatcgaagccagcaaagccatcggcgaccagtgggttgtcacctctggcttgcaggctggcgatcgggtgatcgtttccggtttgcaacgcattcgtccgggtatcaaagcacgtgcaatttcctccagccaggaaaacgccagcaccgaatcgaaacaataacgttgcaggcttaaggggactttcatggctaactattttattgatcgcccggtttttgcctgggtacttgccattattatgatgcttgcaggcggtctggcgatcatgaacttaccggttgcgcagtatccgcagattgcgccaccgaccattaccatcagcgctacctatccgggtgccgatgcgcaaacggtagaagactcggtcactcaggtgattgagcaaaatatgaatgggcttgatggcctgatgtacatgtcttcaaccagcgatgcggcaggtaatgcctccatcactctgaccttcgagacggggacatcacctgatatcgcacaggttcaggtgcaaaataaactgcaactcgctatgccttcattacctgaagcggtgcagcagcagggaattagcgtcgataagtcgagcagtaatatcctgatggtagcggcatttatttctgataacggcagcctcaaccagtacgatatcgcggactatgtagcgtctaatatcaaagacccgctaagccgtaccgcgggcgttggtagcgtacagctctttggttccgagtacgccatgcgtatctggctggacccgcaaaaactcaataaatataacctagtaccttccgatgttatttcccagattaaggtgcaaaacaaccagatttccggtggtcaactgggtggcatgccacaggcggcagaccagcaactgaacgcctcgatcattgtgcagacgcgtctgcaaacgccggaagaatttggcaaaatcctgttgaaagttcagcaagatggttcgcaagtgctgctgcgtgatgtcgcccgcgtcgaacttggggcggaagattattccaccgtggcgcgctataacggcaaacctgctgccgggatcgccatcaaactggctaccggagcaaacgccctggatacctcgcgagcggtgaaagaggagctgaaccgtttatcggcttatttccctgcaagcctgaagacggtttatccttacgacaccacaccgtttatcaaaatttctattcaggaagttttcaaaacgctggttgaggctatcatcctcgtcttcctggtcatgtatctgtttttgcagaatttccgcgccacaatcatcccgacgattgccgtaccggtggttattctcgggacgtttgcgatcttgtcggcggtcggtttcaccatcaacacgttaactatgttcgggatggtgctggcgatagggttactggtggatgacgccatcgtggtggtggagaacgtcgagcgtgtcattgcggaagataagctaccgccgaaggaagcgacgcataaatcgatggggcagatccaacgtgcgctggtcgggattgccgttgttctttccgcagtgtttatgccgatggcctttatgagcggtgcgaccggggagatctaccgccagttctccatcacgctgatctcctccatgctgctttcagtatttgtagcaatgagcctgacccctgccctgtgcgccaccattctgaaagccgcgccggagggcggtcacaaacctaacaccctgttcgcacgcttcaacacgctgtttgaaaaatcaactcagcactataccgacagcacccgctcgctgttgcgttgtaccggtcgctacatggtggtctacctgctgatttgcgccgggatggcggtgctgttcctgcgtacgccgacctctttcttaccagaagaggatcagggggtatttatgaccaccgcgcagttaccttccggtgcaaccatggttaacaccacgaaagtgctacaacaggtgacggattattatctgacaaaagagaaaaataatgttcagtcggtgtttaccgttggtggctttggcttcagtggtcaggggcaaaacaacggtctggcgtttatcagcctcaagccgtggtctgaacgtgtcggcgaggaaaactcggttaccgcgattattcagcgggcaatgattgcgctaagcagtatcaataaagccgtcgtcttcccgttcaacttacccgcggtggctgaactgggtaccgcgtcaggttttgatatggaactgctggacaacggcaatctggggcacgaaaagctgacccaggcgcgaaacgagctgttatcactggcagcgcaatcaccgaatcaggtcatcggggtacgcccgaacggcctggaagatacgccgatgttcaaagtgaacgtcaacgccgcgaaagccgaggctatgggtgtggcgctgtctgatatcaaccagacaatttccaccgccttcggcagcagctacgtgaacgacttcctcaaccaggggcgggtgaaaaaagtgtatgtccaggcaggcacgccgttccgtatgttgccggataacatcaaccaatggtatgtacgcaacgcctctggcacgatggcaccgctttctgcctattcgtctaccgaatggacctatggttcaccgcgactggaacgctacaacggcatcccgtcaatggagattttaggtgaagcggctgccgggaaaagtaccggtgacgccatgaaatttatggcagacctggtcgcaaaacttccggcaggcgtcggctactcatggaccggactgtcgtatcaggaagcgttatcctcaaatcaggctcccgcgctatatgccatttcactggtcgtggtgttcctcgccctcgccgcactttatgaaagctggtcaattccgttctcggtgatgttggttgttccgttaggcgtcgttggcgcattactggccaccgatctgcgcggcttaagtaatgacgtttacttccaggttggtttgctgaccaccatcgggctttccgccaagaacgccatcctgattgtcgaatttgccgttgagatgatgcagaaagaagggaaaacgccggtagaggcaatcatcgaagcagcgcgtatgcgtttacgcccaatcctgatgacttctctggcctttattctcggcgtcctgccgctggttatcagtcatggtgccggctctggcgcgcaaaacgcggcaggtaccggcgtaatgggcgggatgtttgccgcaacagtgctggcaatttacttcgttccggtctttttcgttgtagtggaacatctctttgcccgctttaaaaaagcgtaacgtgtaaatgagagtaaggttgaacgtgagggttcagccttactctttcctgctaaccattcaccactcaacaaccagctaaccgtcaggaataccaggcttagtacacagcactgaaagtagaaaccactccagccattcgtcatcaatttgaacagcacaatactgacccacattcccgtaatcgtatgaattgttagcttaataatcccaaacatgccgagtcttttcctcctgaaaatacctataccgcctggcaaactgcgaaagagaactagccggtagcccggcagaaatcatcaggaaagagtttcacatgaagcagacgtgagatcctgaccaatattcaaatgcgaaatatgtcaggaaaaggtacccggcgaatgttgcgaaaactgatgtggcgttacaccataatattgtctaaatgtatttataaagtatgacgtactgctatagccacatttttccgcaatagtatgcagaggtatttgacgtaactcgagtaatcgtctggccatcgacatcctggaggcgagtaatattttactgaaacaggtattttcatcctgcaacttttttttgatgagactctcgctggtgtacattctttctgcgatatcgcgtagataccaacgtttagcgatatcaaagctaataaggcgttcaacttttcctgaaacagtactgatactattgaaaagtaaggggatcagttctttcttatgagaaaacattgataaacaggaaagatagagcattttgctcagtatcggcgaattgacccgggggtcattgaaactatcaaaaatcgccgtcaccagctgtatggggggtgactggttaattaacaaacggtctttgctatgcaatcctaaattgcgtggcaactgacgaatattttgtaagtaatggcaaactgtcagctcttcgatatccagctgtcgcgtatccagtgaacaaaacgcaaaatcgtctgccaaatttttatccagcagcaggatactctcgttatgcaacgatattttttgctgttcatgatgaatatcgaatgaacgacgaacgaggatcaccgagcagacatgagccatgactatcccttatatttcattactgcgattatttcaatgtcagtatactaatgaaatgacgccagactgtttctgtgtgcaaaaactgccatatttggtaggaccaaattttatccacaaagtagttttgcataacagttaattgataataagtaaatgcaacacgattatattttcacacagcgtatagcttatgtttataaaaaaatggctgatcttatttccagtaaaagttatatttaacttactgagagcacaaagtttcccgtgccaacagggagtgttataacggtttattagtctggagacggcagactatcctcttcccggtcccctatgccgggttttttttatgtctgagtaaaactctataatcttattccttccgcagaacggtcagtgccgtaaaaaatcccttgcgcagccatacttgccgccgggccacagttcggtaattcctgcgccgatcgctcctgatactctgtgggcgtcatcccataataatttcgaaaaacgtaaatgaaatacgacacgctgtgatatccacaggacactgcaactcgcttaattgaaaccccatatataacaataagttgtaaagcacgctgcatcctacactcagtaagcaactgtgaatatgacgtaccttcttcgcgcaattttttctttaacaggcttggactcatcaacaattcgctagcaattcgggctaatgtccactcatgggcgatattattattgatgaccgtacaaactcgtgttcgcatattcggttgcaacacgttcagaagtaacggtataaactgcgtatcctcaagaaaaacagataacaacgcaaagattaatgcccttttacgtagcatttctgcatagcgaagattcttattctgcgatagttgcgcaacttcctgaaaaacaggaatatctctggtacagtgatgaacgagtaatgaaggaacttttttatgtacatgaagctttaatgcctcctccttgagcatcgggagaaataatgaaatcgtgtctcttgaaactaatacgaaattctcaacacacttatccacttgaatttggcttgcatccgcaaaaaccagatcaccgccattaaaatagcgatattcaccattaaccatggtgagaatatatttatgtcttgcgtacgcaattagacaattaccatgtagtggttgcatagttgacttaatattacataaacatactactgtttattaatgtagcacgccgccctcttaagtcaaattgattgataaataaatttaaacgaagcgggaaaacaggatgataatgagcgatgatactcgggctggatgactggatttattatataaaaaggggacttaagaacgcagaggaattaatagtaagcaaataattcatcatcgtaatattaagcagtatcgctagctccataacattcatataacatatatcttatcaacacgatgaatagacaggtaatatattattgcaattaataaatagccgaataccccacctgttttttaaaggttgggcattcggtttttacaacgtgatgttatcaggtgtgtttaaagctgttctgctgggcaataccctgcagtttcgggtggtcgctgagatatttcagggaggctttgtagtcttccagcaacagttcagcaaagtccatttcgaagccgcgacaacacataatgcgcatcaccacgatgtcggtggcttcaccgccgagagtgaaagccggaacctgccagccgcgcagacgcagacgttcagagaggtcgtacagggtgtatcctggatcttcaccatctttcagtttgaagcaaaccgccgggatgccttcgtccgggcgacccgtacagatgaactcatacggccccagtttggcgatttcatccgccagataagcagcaacctggtaggaagcgttctgtactttggtatagccttcacgaccgaggcgcaggaattcatagtactgtgcaatcacctgacccgccgggcgggagaagttgatggcgaaagtaccaatctgaccgccgaggtagtcaacgttgaacaccagttcctgcggcagcgcttcttcatcacgccagataacccagccgcagcccagcggagccagaccgaatttatggcctgaagcactgatcgatttcacacgcggcaggcggaagtcccagacgatatccggggcgacgaacggtgccaggaagccaccgctggcggcgtcgatgtgcatgtcgatgtcgataccggtgtcggcctggaatttatccagcgcatcgtgcagcggctgcgggaactcatagttaccggtgtaggtcacgccgaaagtcggcaccacgccgatggtgttttcgtcgcaggcttcaatcatgcgtttcgggtccataaacaactgaccggggcgcatagggatctcacgcaactccacatcccagtagcgggcgaatttatgccagcagatttgtaccggaccgcacaccaggtttggtttatccgttggtttgcctgcggcttccatacgcttgcgccaacgccatttcatcgccatcccgccgagcatacaggcctcggaagaaccaatggtgttggtgccaacggcctgaccatttttcggtgcaggcgcatgccacagatcggcaaccatgtttacgcaacgcaggtcgattgcagcggattgcggatattcttctttgtcgatccagtttttattgatcgacaaatccatcaatttatggacgttttcgtcgtcccaggtctggcagaaagtggccaggttctgacgagcgttgccatcaagatataattcatcattgataatctgaaatgcaacatcatcgcgcatttcgtgcagcggaaatcgttttgactccacgatagtagaaatggcctttgcgccaaaacgtgaatcgagtagttctgagcggaaatccgttaacagcttctggtccatttcgaactccttaaatttatttgaaggcaataaaaaagtaggatttatccgcaatggaagcaaggtattacaggcttaatttaaataacaaaatcctaagcagaaaaacgactttttataatataaacatttaatatgataatattaaaaacagactttattatcgtaataaaaatcgcccaaacactcctgttcgggcgatcaaattaattattgtttatcctgcatatacggcgtgtaaaccccgttcagactgtgcaggaaagctacgatatcatccacatcttcctgcggcagctctttgcctacctgatagcgcagcatcagtttcaccgccccgtccagcgtcggcacgtcaccgcgatggaagtacggtgccgttaaagcaacgttacgtaaaccgggtactttctgacgcaatttatcacgctcttctttagtaacattcatacgaccaatatccgccgccgtaatttcaccaaagttaaagtcttttttcagccccaacggttcaaaggaacgtccaccgagaataataccaccatgacaagttgcacatttattatctttaaataattgatagccttttttctgttgcgccgtcagagcattctcatctccacgcaaccatttatcaaatggggaatccggcgtaattaatgttttctcaaattcagcaatggcatcagtaatattttcgccactgaaaccttgcggatagacttcgaggaactgcgctttaagctgcggatctttttccagcttagcaataatttcgtcccaggatttcgacgccatttcaatcgggttcaacggcggtccaccagcctgatcctgcaatgttgccgcacgaccatcccagaactgctcaacgttaaatactgagttaaataccgtcggcgcgttaatcggcccaactgcgccaccaacaccaatcgatgtttttctaccatcgacgcctcccgcattcaacgcatggcaatgagcgcatgaaatggtgctatcagccgataaacgaggatcgtgatacagcgcaaagcccaacgccactttttgcgcatcggtaggcagtttttgcgggatgggctgcaccggttcattgcgatgctccggagcagtatcattgctggcgtaatattccgcgcgctgttttgcaatccaggccagtatttccgcccgctcttcatcactcaccttacccgcccagtgtagcgcggtataacgcgttggcggcatagtttcatactgcatcacccattcaatcttattcagatcgctttgcgaaacgggtttattagccagcagagccgcacgcacggcctcgaggttaaaagatttatatccaagctttatgtcgtaatccatcaactgtttcgcgccgggaatataataataggcaggtaattctgccgaaggcgtatggcaataatcgcatcctttttcgcggagaaagcctaaaaccttattattttcactgacagcagatgcctgaacatcggcctgtttactgcgtttattatcgtggtaccacacataaccagataaccctaaatagcaaatcgcgacgccagccaggccgatcgcggtaatacgtgagaccattttcattattcttccctcacggtggtgagttattgtgacccagaaaattttccagaatgctgcaaacgtctctgcgagacaaagccatcataaaaaacagggagatatgctttttgataggaatcaatcaattacatgaatataaactatcaataagatagccagtgcctattacccagatcaggaatggcatatcatgattgcggcgagagcaggattgaatgttctgaaaatgaaaaacaacacgaaatccgtatttttataaattccattgatattagtgcgttatattttttggcaggttaataaacgtgatccaccgcacgctttgtcgcccaccaggcggagcgaatgactacccttaaagaaaagcccgataattagcgacgaatttcggaggtcggatccttatgctcaatcagaaaattcaaaaccctaatccagacgaactgatgatcgaggtcgatctctgctatgagctggacccgtatgaattaaaactggatgagatgatcgaggcagaaccggaacccgagatgattgaagggctgcccgcctctgatgcgctgacgcctgccgatcgctatctcgaactgttcgagcatgttcagtcggagaaaattttccccgacagtaaaacctttcccgactgcgcacccaaaatggacccgctggatattttaatccgctaccgtaaagtgcgccgtcatcgtgattttgacttgcgcaagtttgttgaaaaccacttctggctgccggaggtctactccagcgagtatgtatcggacccgcaaaattccctgaaagagcatatcgaccagctgtggccggtgctaacccgtgaaccacaggatcacattccgtggtcttctctgctggcgctgccgcagtcatatattgtcccgggcggccgttttagcgaaacctactattgggattcctatttcaccatgctggggctggcggaaagtggtcgggaagatttgctgaaatgcatggccgataacttcgcctggatgatcgaaaactacggccacatccccaacggcaaccgcacctattatttgagccgctcgcaaccaccggtttttgcgctgatggtggagttgtttgaagaagatggtgtacgcggcgcgcgccgctatctcgaccacctgaaaatggaatatgccttctggatggacggtgcagaatcgttgatccctaatcaggcctatcgccatgttgtgcggatgccggacggctcgctgctcaaccgttactgggacgatcgcgacacgccgcgtgacgaatcctggcttgaggacgttgaaaccgcgaaacattctggtcgcccgcctaacgaggtgtaccgcgatttacgtgcgggggcggcctccggttgggattactcttcccgttggctgcgtgatactggtcgtctggcgagcattcgtaccacccagttcatccccatcgatctgaatgccttcctgtttaaactggagagcgccatcgccaacatctcggcgctgaaaggcgagaaagagacagaagcactgttccgccagaaggccagtgcccgtcgcgatgcggtaaaccgttacctctgggatgatgaaaacggcatctaccgcgattacgactggcgacgcgagcaactggcgctgttttccgctgccgccattgtgccgctctatgtcggtatggcgaaccatgaacaggccgatcgtctggcaaacgccgtgcgcagccggttactgacacctggcgggattctggcaagcgagtacgaaaccggtgaacagtgggataaacccaacggctgggcaccgttacaatggatggcaattcagggatttaagatgtacggcgatgaccttctgggtgatgaaatcgcgcgcaactggctgaagacggtgaatcagttctatctggaacagcacaaactgatcgagaaataccatattgccgatggtgttcctcgcgaaggcggcggtggcgagtatccgttgcaggatgggtttggctggactaacggtgtggtacgccgtttaattggtttgtacggcgaaccataatatttttacagccagccgctaacttcctgctggctgtaaaattatcctcttcaggaggagatatttaacatcattgccgcctgggtgcgatttttgacttccagacggcgatacagtgattccagatgcgcttttaccgttccggtactgatattcagcgccctgccgatctctttatttgattcgcccgccgctaacatggttaaaatctcccgctggcgggcgcttaacgatttgagatctttaatgtccttttccggcgtcgttcgccagtctccaggcagaaacatcatccccatcgccgcactattgaccgccaacgcaaatgtctcgacggttgaatcacgaggcacaatggccagcacattaaaatgaataacttcctgtaaccaccgtttgttgcaatccgtcgccgtaattaacaccttaacctcaggaaattgcaccacggttttttgcagcaacctgtagcaaaactcaccatcctgatcgccatcgagcatcactaaggcttcagggtaactttccagcttttgccataactcgtctgcctgactggccccctgaatactcactcctggaatacgatgctgtaaactgattttcattccatgaataaatattgactgcctgtcaaacatgactatttgcataactgaatctccacctgaatacgttaaaaagacttaagtagtggaagggtattacccgcgagaaaaaataagaattcgccatttggcggtggccattctacagagatgacgcgtagaaaatagttaccgatataaatagttacagctaaacgcctgaaattacatgtcgagggcactatttaaaacatttttgaggatttccttatatcggtagttagtacgcatgcaattaaaaatgaaattccgcgaccataaacaaaaataacaaacggcaatgagataaaaataagcacaaatagccaatacatcttctattcactttaaagggaatcgctgaaaaatacgctctgtttaagggaattcacctttctcataaagctattcctcccttttcctgctgagaaatcgccacattcatcatgacaacattgtgaaacccggcattagatgttagaaaaaacaataaacaatgcgatatgcgcgctactgtttcgttgtgaacaacaatcggtcaaagaaatggataaaattcacgcaatgcagttgttcatcaaagtcgcggagctggaaagtttttcccgcgcggcggatttctttgctttgccaaagggaagtgtttcgcgccagatacaggcactggaacatcaacttggcacccagcttctccagcgcaccacgcgacgggtcaaactcacgccagaaggcatgacctattatcaacgggcaaaagatgtgttgagtaatctcagcgaactggacggtctgtttcaacaggatgccaccagtatcagcggtaaattacgcatcgacatcccgtcaggaatcgcgaaaagcctgttactgccgcgcttgtcggaatttctctatctgcatccgggaattgagctggaactaagtagccatgaccgtccggtagatattcttcatgatggttttgattgcgtgatacgcactggcgcattaccggaagatggcgttatcgcccgttctctcggcaaactgaccatggtcaactgtgccagtccacactatctgacgcgctttggttatccgcaaagccccgatgatctgacttcacacgcaatagtgcgttatacaccgcacctgggtgtacatccgttaggttttgaggttgccagcgttaatggcgtccagtggtttaagtctggcggcatgttgacggtaaacagtagcgaaaactatctcgccgccggtattgccggtctggggattattcagatcccgcgcattgccgtgcgcgaagccctgcgtgccgggcggcttattgaagtgttgcctggctaccgtgccgagccgctgtccctttcactggtttatccgcagcgtcgggagctttcccggcgtgtaaacctgtttatgcagtggctggctggcgtaatgaaagagcacctggactgaccgactatactttttaagaataaccacgacagaaggacaaaagagcggatgacgcaggaaaacgagatcaaacgtcccacccaggatctggagcacgagccgattaagcagttggataatagcgagaaaggcggcaaagttagccaggcgctggaaaccgtcaccaccactgccgagaaagtccaacgccaaccggttattgcgcacctgattcgcgcgacagaacgctttaacgatcggctgggtaaccagtttggggcggctatcacctatttctcatttttgtcgatgatccccattttgatggtgtcgtttgccgcagggggctttgtgctggcctcccatccgatgttgctacaggatatcttcgacaaaattctgcaaaacattagcgatccgacgctagccgccacgttgaaaaacaccatcaacaccgccgttcagcagcgtacgactgtagggcttgtcggtctggcagtggcgctttattccggcatcaactggatgggtaacctgcgtgaagcgattcgcgcccagtcacgcgatgtctgggaacgctcgccgcaagatcaggagaagttctgggtaaaatatctgcgtgattttatttcgctgattggtttgttgattgcgctgattgtgacgctttctatcacctcggttgccggttctgcgcagcaaatgattattagcgcccttcacctgaacagcattgagtggctgaaaccgacatggcggttgattggcctggcgatttccatcttcgccaactatctgcttttcttctggatcttctggcggttgccgcgccaccgtccgcgcaaaaaagccctgatccgcggaacatttctggctgctattggttttgaagtgattaaaatcgtgatgacctacaccctgccatcgttgatgaaatcaccctctggcgcagcatttggttccgtgctggggctgatggcatttttctacttcttcgcccgtttgacgctgttttgcgcggcgtggattgccaccgccgaatataaagacgacccgcgaatgccggggaaaacgcagccttaaaataggccggatgcggcgtacgaatttattcggcctggctccccgtaggccggataagatgcgccagcatcgcatccggctataatgcacacataacctcttgaaactctttcccagagcctctttagccatctattcaggagcaaacaatttcattccaacttataaccccagcatataaatccagttggtaacttttatttaacctaaaaccagtttaatccaccatttataaaattatgtgaagcatttcatagaagaaaaatcactggcctaaacattatcccctttttgcctgatttttgaccatttccgcgatttgttacacattgaaatatcacttttgctgtgcgtaatatggctattcgttagccaaaaaataagaaaagattatgcaagcaacagccacaacactcgaccacgagcaagaatacacgccgatcaactcgcgtaataaagtccttgtcgcctctctcattggcacggccattgagttcttcgacttttacatttacgccactgcggccgttattgtgtttccgcatatcttcttcccgcagggcgatccaacggcagcaacgctacagtcgctcgccaccttcgccatcgccttcgtcgcgcgccccattggctctgccgtttttggtcattttggcgatcgcgttgggcgtaaagcgacgctggtcgcctcgttgctaacgatggggatttcgaccgtggtgattggtctgctgccaggctatgccacgattggtattttcgccccgctgctgctggcgctggctcgatttggtcagggtctgggcttaggtggtgaatggggcggcgcggcgctgctggcgactgaaaacgccccaccgcgcaaacgtgcattgtacggctccttcccgcagctgggcgcaccgattggcttcttctttgccaacggcactttcttgctgctttcctggctactgaccgacgagcagtttatgagctggggctggcgtgtgccatttatcttctcggcggtgctggtcattatcggcctgtatgttcgcgtgtcgctgcatgagtcgccggtgtttgagaaagtcgctaaagcgaaaaaacaggtgaagatcccgctgggtacgctgctgaccaaacatgttcgcgtaaccgtactgggtacgttcattatgctggcaacctatacgctgttttacatcatgacggtctactctatgacctttagtaccgccgccgcgccagttgggcttggtttaccgcgtaacgaagtactgtggatgttgatgatggcggttatcggttttgcagtgatggttccgttggcgggtctgctggcagatgcttttggtcgccgtaaaagtatggtggtgatcactacgcttatcattctgtttgccctgtttgcctttaacccactgttgggttctggtaatccagcattggtgtttgttttcctgctgctgggcttgagtttgatgggcctgacctttggtccgatgggggcgctgctgccggagctgtttccgacggaagtccgttataccggagcatcgttctcctataacgtatcgtcgattctcggggcgtctgttgcgccgtatatcgcggcctggttgcagactaactatgggttaggcgcggtggggttatatctggcggcgatggccggactgacgttaattgccctgctgttaacgcatgagacgcggcaccagtcgttgtagtcgttttaactgccggatgtcagacatccggcaactatcatcacttcttcatctgcgacaaaattgtccggcactgattagcctccccttcggaaggtgagatcagtgccagcaatgctgccgctggcgtaaccagcgttgccagtgccgccgcaacagcaccacgggcaatcaacggcccggctttcaccccagcctgcggatttttaaacgtcccacgcacatacagcggcgaacgcagcgtgataatgcgaatccctttactttctggatcgatagttaaatccagctgttccgaagcaaaacttgccgtgccggtaacattgatcaacgcattctcggtatcaaaagcgaaaacctgcggacgcgccacaccgttggcaatatccagattcgctgccgcgcagttcacccgcacctcatcgtcaccaaatatcgcaccgacaatgtagttaccaacattcagcccgacaatctccatcaggttgcggctcaccagcccgtcattcatcaacagtttcaggttgccattactgttgcctaaaagcgccgccaccgagttaccgctaccgcgtagttccgcgtcaccgttcatttcccccagcgtcttctgcatcagttccacatccggcatcagttctttcagtttcagtcgacgagcctgaatatctgcccgcccctgcatcggctttttatcgccttccagatgaatattcgccgcaatgctgccgcccgctatgccaaatttcagcggttgcaggcgcaggtcagcatttttgaggatgatatgagtagaaagatcgctaatcggcaggctgctgccatgctcaatgcgccgccctttgaagcgaacatcggcatccataacgtcccatttatcggtttcgaagcggtcataaggcagcactttgcccgcaggctgaacgcttttttcgcccttcttctgttcagaccgtttcgacttttctgcccctttcccggaatcaacgccaatcaacggtcccaggtccgccagccgcaattgccgcgactcgacatcaccttccagttttggtcgtggcttgccggtggtatagatcagagaaccgtggatatcgctatcgccaatgcgcccattaaaaccgcgataatcaaagaccgacgatttttcagtgtcgattttcgctaccagccgaccatccgtttcaaacggcggtgtatcgggcagcagaacgcccgtcagttcatagagatcacccagcgaatcgccagaaaatttaagccgtaaatcgacaccccccatcttcattgggtcattcacaacgccatcaaaagcaacacgggtgttaccagagcggaaatcagcctgtaccggaaacggcgttccttcgccacgcagcgccagcataccgcctatttttcccgtaccagtgagcggttcaccgttataacgtccctgcgccttcaggccaaaaacgtaatcgcccaccttttctttatccgctttacctttcgatccggtaacttcgctgaacggcagcggcttgcctaacggatcgacaaaaatttccagatccgctttgcttactttgtcatcaatggcgatccgcccttgatcgaaaagaatattatccagctgaaacgaccacgccgacggctttgcattcgcgtctttgttgtcatcgttggcgagattaaacgtccagttattgttcttttcggagaggcgaatcaggcgcgcgtcgggcttttcgagcttgatccacggcaaccagaccgttttggtcagcagcgccagcggggccagcgtcgcttctactcgcggcaaatgcaccattgtgacttcgggaatatccggtggattgccaagaatgatgtcttccgcgtgtacatggggccacggcacccagctgcgccagccagtttcttgtttttgccgctcccacaccacgcccagatcgccacggatagcgaacggacgattcaactccgcagagactttctggttgatggtcggtttgagtcgattccagtcaaaagttgcaatcaaaatgatcgccacgacaatcaacaacaagaaagcccctgaaatcgcagcggttattttgcctgccttgctcatcgttcgcttcctcatattcttcctgtgccagtcctaaagatagtccagccaggcggaaaatgaggcagcttatagcgccagaaccgccgtattcagcgtttctatcggtgccgggcgtgaaagaaaccagccttgtgcggcgaatgcgggcgagttctgaacatcacgccactcttccggtgtttctacgccctcgacaatcaccccgcgacaatagcgattcattagatgtaaaagctgagaaaagagtgtgcgtccttccggcgactgacgcagcatcacaaacagttctcgcgcgattttgatgtagtcataacgcacttcacttagtgcagagaaatttgccatcccggtaccaaaatcatccagccacagcgggccaaattcacacatcgaggcaaaggttgaatctttcggcaggcggatgtgttccaccagttcgaaacgcagccagggaagatcctcaatctggcgcaggatttttggttgctgactcagggcgatgagcgtagggccatcaatattgaccgatgccagcaggccgtgctctacaaagaagtcggctttttgcgccagcaaatcaatctgctctttcacaacctccatccgatggctaacggtgatttcagtaaaatagcgatccggcggcaggcgttgcgaagggttcaagggatgcgtgaccaccgttaatagctccacggccattaaccgcccgcatgtttgatagatcggctgccaggtgtaagcacgctcacactgcaaccaaaaacgccgttcctgcaagctctcgatgcttgcttcagggttgcttattcgctggataacctgccttatcatcaaagatgtcctgtgtttaaaagtgatgctgcccggactcgacaaagattatcggtgcgcaagggcagaactttaccgcctggccggggtaaatttccccactccacaacggaatctttcaggaatacgttctggctcaaaaaaataatggaacaatgttttaatatggttgaccagcaaaccaccacagcgcaaactaacgctaattttttacagatcaggttcacgactatgtccaaaaagattgccgtgattggcgaatgcatgattgagctttccgagaaaggcgcggacgttaagcgcggtttcggcggcgataccctgaacacttccgtctatatcgcccgtcaggtcgatcctgcggcattaaccgttcattacgtaacggcgctgggaacggacagttttagccagcagatgctggacgcctggcgcggcgagaacgttgatacttccctgacccaacggatggaaaaccgtctgccgggcctttactacattgaaaccgacagcaccggcgaacgtacgttctactactggcgtaacgaagccgccgccaaattctggctggagagtgagcaatccgcggcgatttgcgaagagctggcgaatttcgattatctctacctgagcgggattagcctggcgatcttaagcccgaccagccgcgaaaagctgctttccctgctgcgcgaatgccgcgccaacggcggaaaagtgattttcgacaataactatcgtccacgcctgtgggccagcaaagaagagacacagcaggtgtaccaacaaatgctggaatgcacggatatcgccttcctgacgctggacgatgaagacgcgctgtggggtcaacagccggtggaagacgtcattgcgcgcacccataacgcgggcgtgaaagaagtggtggtgaaacgcggggcggattcttgcctggtgtccattgctggcgaagggttagtggatgttccggcggtaaaactgccgaaagaaaaagtgatcgataccaccgcagctggcgactctttcagtgccggttatctggcggtacgtttgacgggcggaattgcggaagacgcagcgaaacgcgggcacctgaccgcaagtaccgttattcagtatcgcggcgcgattatcccgcgtgaagcgatgccagcgtaaaagcagcatatgcaaaaggctggatagagtgttacccctctatccagctcatccataaatacctgatggttgtgctaactcatcaccatcaggcattactgtacaggtggaatatccgtcacttcaggatgtacgtcatccgtggcgacagatgtggcggcagccgcagtcgatggggccatgatttgatcccaggccgcctgcaacgctttcatgttaaattccggctcgcctttcggctgcagcagtattaacgccatatcattcgacaactgctgacgcagatcctgatttaacatctccaccgtcaggctgttaaggaaatcctgacgcagtttctgatattgctccggcgcgatatcgacgacctgattttgcaacgaacgcatccgctgccccatcagaatatcggtatcagctcgcgcataggcggcaaacagtttctgcagctccagtttcttttgcgccactaacgcattgaactcttcttccggcagacctttatcgcgaaccttcgccagttcacgcgccaccagattaaggttgctgttcagcttgtcgtttggtgattcgatgttgatggcacactgcgcacgcagatacagcacacgacagtcaaatccaagaccgatgtctttactgttactggcgcttaacgcttgctgaacatgccagaacagcgcctcacgggccaggtccgcacgccagtagcgcagcagtgcggctgattcacgaatcggctgccacggcgtatcccacatgatagatagccggtcctgacgcaccgcgtcggtcataatactcaccgcttccgcacgcagcggagaaagcgtcggcaccggagccggtgtttcacgtttgcctttcagttcgccaaacgttttattgatttggtcgacgaccgagcgcgcatccacgtttcccaccaccagcagcgtcattgcatccggggtgtaccatttctgatagaaatctttaatcttttccgcttcaacgggttgtttcagcggatcggcaggatcgtgacctaacaaggttgatcctttcagacgataacgccaccagccctctttagtatcggcaggccaggttgccaccatgtcctgactttgcaacgcatggttgatggtttctggcgtgatagtcagtttgccagtggcatttgccagataagagagcgcctctttcagcaagtcgttacggttattgggcaaactcagattaaacagcgtggtgtcataagagacaattaccggcggcatcgggcgtttagggtcgatcccctgctgccacaatgaacgcgcctgcgctgcgtcaaggccaccgctttgcgttagcgcaatacgagggatggcgtgactgtaaccgctctgttgtgtactttcggcgagcgaaccggtattaaccagcaggcgaatttcaacacgatcgctgggacgctggggcgtagtcagcacttgccactgtaaaccgttggaaagcgtcccctgttgccatgctggatcaggctggagcgcatctgcctgcacataaccagcagtggccatcatcagcaaaccgcccgctaaaagtcgaatttttgtgccctgcatgtgaacccctgatcaactatcctggtaataaaaaactgcccgttgtcggtcagtctaaatgacgttaaaaacacttcgtgttagaccgcaagaacatgaaaatgtcacggaagaagtgaaataaacctgaactcacccaggtggtaagttcaggcacaggggtcaattatgcgcaaacacccgcactcggggaagggagtgcgggcataagtggtgagattaagaggataattcgtgcgttttgccatccggcgcacgattattcagcacatcgtccagttttttgtggtctagttctttcacccacttagcaacgacaatggtcgctacgccgttaccgaccaggttagtcagcgcacgagcttctgacataaagcggtcgataccgaggatcagcgccagacccgctacaggcaaatggcccaccgcagagagcgtcgccgccagcacgataaaaccactacccgttacccctgccgcccctttagaagaaagcagcaacacgattaacagcgtgatttggtggacgatatccatctgactgttagtggcctgggcgataaacaccgccgccattgtcaggtatatcgatgtgccatcaaggttaaacgagtagcctgtcgggatgaccagccccaccaccgatttgcggcagccgagtttctccatcttgtcgagcatacgcggcagcgccgactcggaagatgaagtccccagtacaatcagcagttcttcacggatgtaacggataaatttgaagatactgaaaccagtcgctttagcgattgaacccaataccagcaccacaaacaggatacaggtgatgtagaaacagataatcagctgccccagttgcaccagtgtgccgacgccgtatttaccgatggtaaacgccattgccccgaatgcaccaataggtgccagacgcatgatcatattgatgatgccgaaaatgacctgcgagaaactttcgatcacgttaaaaatcagttggcctttgctgcccagacggtggagcgcaaaaccaaacagtacggcaaacagcagtacctgcagaatgttaccgctggcaaatgcgccaatgacgctcgccgggatgacatccataatgaaggcgacaatgccctggtctttcgcctgatcggcgtaaaccgctaccgctttcgcatcaagcgttgccggatcgacgttcattccggcaccaggctgcacgacgttaacgatgataagaccaataatcagcgcgatggtactgacaatttcaaagtaaagcagtgcgactgcgccggtacgaccgaccgccttcatgctttccatgcccgcaatgcccgttacgacggtacaaaagatgacaggagcgatgatcatcttaatgagcttaacgaacccgtcgccaagcggtttcatttgctcgcctatttcagggtagaaatggccaaggagaataccaatggctatcgctgtcaggacctgaaagtaaaggcttttaaacagagaggttttcatagggtgtcctttagtaaaaccacaggtcttgtaaggttatggggtacctgcggccttaaaataacacccagacaacatcacagaaatgtacctggatcataattgaaacaaaaaggttaaaaagtttgagctggctcgcacaaaccagcactttttaaagttttgtaatcagtttggggtagctacttttcttccaggtaactctcttcgaagatttcaatagggagtgggcgagcaaaaaggaagccctgggcaataccaacgccagcttttgccagccagtcgcgttgtgcttcagtctccacgccttcggcaatcatttgtaggttcaggctctgcgccagcatgataattgcagcaatcatgctgctatcttccggcaaaccttcaacaaacattttgtcgattttcagtacgtcgattggcaacgatttcatatgctgcagctgacgcagccctgcgtagcccatgccgaaatcatccagcgccacccgaactccggcattgcgcagcggacggaggattgccaccgcagcatgaggatcgtcaatacgtcggctttctgtcacttccagaatcagtgttcccggctgaatacgatagcgggttaacaattccagcatatccgccaccatatttggatgcatcagttgcagcgctgagaggtttaccgacaagggcagcataatgccgcgctcttgccaggcagcaagcaatcgacaggactcttccagcacccagtgaccgacggtaaccatcagcccacagcactcaatgcgatcgattaagccatcgggcaggtcccaactgccatccggttgctggatacgcagtaacacttccgcactgaccagtttaccgctggtcatctcgacctgtggctgtaaccaaatcgcaaactgatgattttccagtgcattaaggatatcgctctcttccgtcaaccgctgctgggcggcttccatctgctgcggatcaaagaactgaatctgatttttgcctttatggcgagcggtaaatgccgcagaaatagcgcgactgtaaagctgttcggcggtgagatcgccgtagaacatcgccacgccaatgctacagtgcggacggagttgaatacgttcaatcggcaggcgctcgctcatgatagtgagcacttgctgacctaatgtgatagcgtgccacggttcctgtacaccgttggcaatgacagcaaagtcataaccgctaatctgcgcgaggatcatgcgtggcgacagtaccgatttgagtttttccaccagcgtcagcagcagaatttctcgttgcgcctctttcagcacacccgcagtatcacgcagggtttcacaggtgatgatcatcagcgcggtagtttgtttacgcgccaccacctgctccagcatctccatcagcaaggctttgttcggcaaatccgacaccgggaagcgcatcgcattttcgttctgttcttcataatggcgctgcagcaattgctggttgaggttgtaactgcgcaccaacataccgatttcatcgtcctgatgcagacgcggtaatgccagttggtgaccaacaagctcctggggtgggatggcgttaagttcgcgagcaatattgcgtaacggatgcaaaatcaggcggttaatgcaccagctaatcgccaccgtcaatattaacgacaaaagtaagtaaatggtcactaacgttgagagggtgctcatcacgaacttatacatgcggaaggaatccgcctgtaacaccagataggcaattggctgcgggtttgccggacgttccagcgagtaaacgcccagcgagatttgcaccggtagctcaaacaggcgagtaaccattaccggcaccggacgctctggaataaaacttttacgcagcgcctggaactggttgggcagcactacatcggcacggctgaccacgccggccggtttaatgctggcaagaatagcttccgcttcgggaatatcgcctttcaaaatggcagaagataagggttcgcggacagagcgagcaatgctttccagttgcgtagccgtgttatagcgattctgctggaccagatggaacagcaaaacggtgcaaaaaataaaaacgaacaccaggacaacggctgccaccattgccatctgcttgattgttaacgagcgacttacgcgcaaattgtctcccccccggaaatcccagattaccgcccgagtatacccgatcgcagcggcattaagagaggcgctatctgaaaacttaccagtcggcgtaaggtatcagcggctgcggcggtaaatccatgtcaccctgccatccggcggcggaataacgtacgtagagcaggaaatggctgggtgcgtaatcttttgcctgctggatatcaattgccgtgccgacaaaccagttggaagtaacacgtcgttcaagtaatgcccgcgccgtgtagccaaagccctgactgctgccgccatcgttggattgccgcgcagcttcttcctgccagtcggtcgggatcagattcatcagcggataacgcggcatggttttggtgcgtgaatgcgaccacgagccagacgcccccagctcccacgaccagttttccgtgcgctcccgccacatcaccggtatggcaaacgacaggtattcctgcggactgtagtaaccgccctgaccgagtgagtagccactcaggtctttgtcataatgccagatcatgttgttcaggccgattgtgacgcggcgattgttctggttgatgaccttatagtaatagcccgtcatccagcgcacacgccagttatcttcgacatttttaccggttaactgatcaccgctaagcgatgcccagacgccgtttgcttcacctttatcgtaactcagacttagccccacgccgtcggcacgcacgccgccccattttttcccggtattgctcggagagtctttttgcccaccaaaggccagcaaagaactggagatgggccgacggtgggcgttaacggtgtaacccagcggcccgatatcatcgctgtaactgatgccgccgaccacatccaccacgttgaagcccatcggcgtggtaccgatatcccagctccagacgtcatttcgccagccgaccgccacgctggcaccggaatccgactggctgcggttgccgctacagtcctgtaatgtacaggtgccccagttgtcatcccatttgccatcggcattagtggagaaactgccgacgttcatattgacgaaatcactgcgaaagaacatccgcccgtcagaatagggcgcgtccacctgcaacatagtggtgtgcgctttcagatcggagtaaccaccggtaccgctcgaaccccagtaatcgtgctcgagagtgacgttaagatcctgctggcgatagaggtccgccgtatcgctgcgcacgccgcgtttcagccagtcatctttctcgtcgttacgggtcagccgggtaaaggtgtcgttatcctgcggacgcgtcgtggtcacaccggatgcaaccatagcgtctttgtaggtttccagcgcctgcgttggatcgcccgccagcgcttcaaacttcgcaccatcacgcagtaccatcgcgctttccatcgacggtggctgagattttgcctgcgggatcaacttattaaatgtctgctgcgccgctgcggtatcgccaagctgcgcctgtgccagcgccacgcgccgctgtgtgttcagcgaggcgttatcaatggcaggcagtttcgccagctggctacgtgccgccgctttgtcaccggcagcaatatccacttccgtcagaccaagaatggcatcggcgttagttggctcccgcgtcaggacattctgatatgcagcgcgggcggcggtgtaatcacgtcgctgctgcgcccagtcagccagcgtgaggtcaatacgcgaggaaggcggttgctggcgcagcatcgcttccgcttctgcctctttaccgttttctcgcaggcgattagcggtttccagcacctgatcgttttgcagtcgattaaccagctcctgaatattgctgttccactgcccgcgcggcaggctgttgatatgcgccagcgccgctctgtcctggtcgtgaccggagaggtacagcccgtaagcgtaaacctgctccgggtcgttcggcttctgctgcgccagattgcgcattaacgtatcggcctggctgcgttgtccggcttgccagagatcctgcgaaagtcggtaagtaatccatacactgccggggtccagcgccagtcgttgccgctgaagtgctgccgcctgcgcccatttcccctggttttccagtgcctctgcctgctgtgccagacggtcgttttgcaggctgcgttcgatatcatcaatgctgcgccgctggctggcagagagcgaggcgatatacgcttcggctttttctggcgactgctggcggtaaatattcgccagcccgcgcacggcgttagtgttgccgctgtccatacgcaaggtctgctggtaatagcgttcggcggcgggataatctttgcgcgccatcgccacatcgcccagcccaagcactgcatagctgtcggtgttatcgacattacgtgcctgctggaacagccgttctgcccggtcaggattattggctttcagcgcggcatcgccctgctggatcgccagccagtagcggtttactttcagcaggctgttccatttgtcgttattgctgttgtgcggatccagcgcgagggctttttccagattcaccactgcattggcgcgatcgcctttctgggaatacgcctggcccagcgcccccagagcctcactgtctttcgggttcgcccgcaccgcctgttgtagttcgggaatggctttacccgccatgccagagtccaccgccgctaaaccttgcgcacgagcgcggaaagcagggtcggccagctgtttttgctgttctgccagttgcgattgtgcagcagccacgctatcgccatcgctaaagatcgagagatattttttcagtgcctgaacgctggcatcgctgacgggcatgtctttaatctgcccgtaccagattttagaggccccttcgcgcccggcgttcgatttcgccatctgttccaggacggcaaaaccttcgtcacggcgatcgctactaaacagtaatagcgccagattgttttgcaggcccgtattgcccggcgtatccgcattaatgcgttttagctgattaatcgcttcaccacggcgagccggaattttcgccaccgtactccagtactcgacagcaatgtcaccttccggcggcgcaccgttgaacagcttgttgtaactcgccacggcctcttccgcatgaccggtagtcgcctgcaatcgagcctgttgcagtgcctgacgaccatccggcgtagacagtaacattgtggtccgcgacgatttatacgcatttgaactcggcgctaactgcgacagccgatcgagctgtttttgtgcgccatcaatatcgccctgacgtaacagagaacgaaaacgggcagcaatcacatccgggttattcggatcaataagttccagccgatacaacgactgttgcaccaggtcttcacgatgggtcgcttcgcctaaccgaacttgctccagcaactgttgctgagcggttggtgctgcctcgaccatcggcatgacggccagaccgagggaaagcgtgaatatgtttagtgtgaatttgcgcattcctggccccagtcaggtaataactcaccttttgtcgagaagcggaaacggtgttgatcccagccttgtccaaacagggtcagcacatagttgtaataggcatcgctgccgggaaagttatcggccacgcgctggcgctgaacggcctgcgcatcgcggttttgtaaaaagggcagcatggcggcagaaaaaccgaccggtcctttaccctgcgctttccccgtagccacatccactttttccggcggataaccgtttttctcagtgaatgtcgccatcggtttaaaccggttgagcatccgcgctttttgcggatcgctgtcaggcatcatgcctacccacatgtaaacgcggatagcgtcgtagctgctgatcaatgttttttcggcttttagctgccagcctttgtctttctcatagcgcacccagtctggcgaaaagcctttcggggcggtttccagcaataaacgttgattggtttcgcgcagcgtggtccacggcgcgccaaagcgggtgaaatactgcgccagcgtcggcggcaggtagctggggttaaaacgccagctgttatcctcagcaaaacccactttgcccggtaacaacatggagcccagcccaggcaccgtcaccacttcctcccgcgcgatacgttttagcaatgcgctgccgatgtcggtataacgctgctctttccacaaacgccccgcctccagcaacgaccaggccatccagacatcaccatcggaggccgaattgctgtccagcacttcccacttactgttctctttcttgccccacagccaggcgggcaaatgttcttttaaagaaccctgagcgagattgttctgcgtccagtcgagaagattatcgaaagctgcacggtcgttagccgccagggcaaagaacatgccgtaactttgcccttcggaggtggtgattttgcgcgcgtcgctggggtcgatgacgcgcccttcctgactgatgtaatcctttttaaactgctcccaggcaggccaggtacaggctgcctgaacactaaaggcagccagcagcagcatcgtcacgagtccactacgcaacacattcatcttcaattactcgttatccgggttaagacgacgacgactaataatacgcagcagacgccacagtacccatgccagcaatatcacactgatagccgccagcaccgccagcagaatcggatggtttgccagcgcataccacaagcgctcgaaccacggcagatgacctacgtaataaacatcgccaacacgtaggctgttgataccggactcgcggatcaccgcgaccgaaccgaacatggtggcgcgtttgccgctatcgttcaccgcatcgttaagcatttcataaccgcgtgggctatctgccagcagcgcaatcacgctgcgctggtcgttatacggcgactggaagccaatcaccgccgccatcgcaccggaagaggtcagcgttgactgggtttctgccgcgcgatcgctctcgtccggcacaataccggggaacggggtctggcgcatcggcgttttcacccagctttcggtagcctgcaccaacaggtcgatctgcttatcgtctttcagtttgtccgggataccaccgacgatcatgatgtcggcatctttgccctgaatggtgctgccatcatcggtcaccgtcaggttaatcgccgggaagcccgtctgcgcaccgataaagccaacggtattcagcaaggtttccatctgtgcttcgtttggcgttttcggcatcacggtgatggtttgcgacaaatccgccatccggctgaacgggaagcccgcgttagcaaaggcgcgtagatccggcatcgggatgaagtggtaatacttcgagaagtcgatggtggagtcgtcaccaatcactacatgattctgcaccggctggaaggtaatacagttatccaccgaaccgcccggcatcgggttcatatactcaaagtcgaaccgcaactggttggtcgcgcccagtttcagcgccggaatagagacatccgttttgccatccagcaaaccttgtaataccggaatacgcagcagcaggcggttcgcctcctgtttgctgctcaggttgaaggattgcaggaactggttattcaggctgatatccatccgcgaactgtctttcaccggcggcatggtgtagcggtaattaatatccatatcaatgccggtactgcgcatcaggtagagatccggcggcaggtttagtgaaacgttaatcgctgctggctcaagaccgctggattgtaattgttcttcataggttttcagttcaccaaaggtaaccggacgatcggtacgcacccagttcggcgcatcgtacggcttacgcggtagcagcggtttcacttcattcactaccacactttcaccacggaacagaatgttaccctgagcgatacctttcgctgcctgcaacaagtctttgtcgtcacggccaaacaccaccagcagtttgacgtaaggattctgcggatggttaatcatctcaatcaccggggcttttaccgccggatgatcgcgcaggaagtccgggcgtttgtcattggtggcaaagacaatggcattgcgatccggcagttggttatagagcaccgggaagttctgcccacgccagcctgaacgcgaaccaaaccacgaggcgacaatggcagatgcttgttgcagctcaacatccggcgcacccgcaaagaccatcggcaaggtgttggtgcggttatcacgcgggtcaaagaatggcaccgggaagtgtgacaggtcattcttcacattcagggtctgataggtcagatccagtccactgctccgcccaacatccagccaaagcgtggtgctggccgggttttcgcacacgtcctgataatggccgacaaactccagccgcacacggttgaaatcagtaataaacagcgggttaatgggcatttgtgccagcgtttttttacccaactgttctttggtcactggcagcacgcccatcagttcatcattgagataaacctttaactgcgactggacaggcagtaatgatggcgatggcgtgtattcgaggttgagcatcgccttcgtcaccacttcatcgctgcgcataccaaactcaatgctgccgttcgggttaatgccacgtagcaccatgctgcccggcggcggcgcaatttgcgcaaaggtcagcttcacatcacgggaaggaccgttctgcgccacgactggcgcatctgcgccctgcacgcccggcatcacttgccccacctgcggattttgctccgcctgggcggttacagctggctcagcattgatcagtggttgcgttgctggcgtcgcctgcgtcatgaaagaggggaacgcactcatccccagagccactgcacaaatccagaatatttttcttttcatcgcgttatcatcattgttgagccaaagcctgatccgatggttgtgccgtttcgctccgctccgggcggcgcggaataaacgatacaacccaggaaaccagagaagtcagcacacggaatatgcccttcaccgaagaaggcgcaaattccgccagatggcggtagccacggaagccgagcttcagaatatccagcagactttccagcggcttatcttccgggtagctgtcctgccagagcgcccatgtatccgcacgggcaaacgtacactgcacaaaatcgatatgttgctgggtagtgagcggcattaatttcagcccaacttcattacccatcacgcgcgccacctgagccgggaagacgtattcctgctgaccgcgtttaagcaacagattcactttctgcccttccagaatctgcgcctgaccgttgatcttgatccccaaaccaccgtcggagaaatcctgaacggtacacgagaagagatgaccatcttcgcgggcaattgctgcgggcatcgtcatctccacgcggtgcgatcggcgtacctgtttgctttctaccgataccgcgactgcgccgccgagaataatcaggttgtagaatacccacaccatactgacgaccacggtgagcatctcagttggcggaccatagaagtagcgccagatcccaaccgctacgcccaccaggttgagcagaacaaggaagatgtagggccgcgagatcacccagtcgacgtactcttcttccaccagtccacctttggcggtgacgttaaatttgcctttgtgcgggttaatcagcgccaccagcgtcggtggtgcgatataccacgccagcaccgtttcgtagatttcactccagaaagagtggcgatatttgccctggatcttcgagttagtcaggctggcatggatcatatgcggtagcacgaacagggcgatcatcaacgctggcgcgtagatgatgtaggcatgaaacagcaggaacgccagcggcgcagtcaggaagatcagtcgtggaatgcccgacaagaagtggaacatggcgttgacatagcacagccgctgagcaaacttcagccctttaccggtgagcgggttatcgagacggaagatttgcaccatcccgcgcgcccagcgaatacgctgaccgatatgcgccgagagactttcggtcgccagccccgctgcctgcggaatacgcatatacgctgaggtgtagccacgacggtgcagacgcagagaagtgtgcgcatcttcggttaccgtttcgacagcaataccgccaatctcatccagcggcttacggcgaatcaccgcacatgagccgcagaagaaagtggcatcccacatatcattgccgtcctgcaccagaccatagaacagcgtgccttcgttcggcgttttacgaaaacgccccaggttgcgttcaaacgggtccggcgagaagaagtggtgcggcgtctgcatcatcgccagctgtttctctttcaggaaccagcccatggtcatttgcaggaacgatcgcgttggtacgtggtcgcagtcgaatatcgacacgaactcgcctttggcatatttcagcgcattgttgatgttgcccgctttcgcatgttcatgagtggtacgggcgatatatttcacccccacgttttgcgcaaactggcgaaactcttccctgccgccgtcatcgaggatccagatgttcagcttgtctttcggccagtcgatacccagcgaagcgtaaatggtatttttcaccacattgagatcttcgttgtaagtcgggacaaagatatccaccgacggccacagcgacatatctttcggcaatggcaccggctgacgattcagaggccatacgacctggaaatagccgagcaccagcacaatccacgcgtacgtttcggcgaacagcagaataagcccgcacaccaggctgaccggatcgtcccagtttaacgtcgaggtgtaacgccaccagatataacggcaagaaacggtcagcgacagcacaatcagcatcagcgccgagaagcgccccggcatccgccgtacgatcagcgctaccccccacagcagcatcaggaagataaactgcgctagcgggttaaacggctgagtaacgcagattaacgccagaatcagcgagaaggtgacgatgataccaaggatcaaccgccgcgccccggcactcaaatgaccgagctcttttttctcatcaagatgctgtgttttatggctaacgcgctcaggcagctcgttcatccattgatggtaacgtccacgaatattttgtagacctgaaaatgcccgcctgcgcggtttcggcgtttctttgcgcgatgcaccgatcagtaaccagcatgtttgaataagataacggaccgggtccagcggacgcggacgcgaggcgttgatatgcggatacaggtttttatgttctgcgcgaatacgctgccagcgcgggtgctccagcggaataaaaatccaggccaggatcatccagaaacagccgagcgtcgcgctgaaagccgacgcaccgtgacgacgataatcgcgataacgcccaataagccgtgcgttgaccggcgggataagcaaccaccgggtcaggatactcatgatgcactcccgactggcgttttcagcccggaataattcaacaggcaccagttcgccagcgtcaatatctcttcagccgccagcgcatcactgcgatattcaccgactggttacttagctgccagacattcagccatcgcttcatcacgatgaatgagcatcggcagcaatcggcgctggctttgcaaccaaagctggtaaatatcgtcctgaaactggctgccaatacggaagtcattaatcaaaatatgtgcaccatccggcagcgcttgctgatgcagtcggatatggcagttggcatccacattgacgattgccagcgagtgatcgcacaaactcagcagctggtgggttatctgcgaggcatcacgcggtaagtcaattaaaatccactggtaacgcccgctggcttttagttgctgtaagccggtgcaaatatcgctcagccgggtttgccagtgctgtggattttcttgttcttcaatggataactgaccaaaaggcagcaaatcgagctgcgaggtatagcgcaacccggcgtcacgccagtcctggccatccagcatagctctggcccaaccctgacggtgggtaaaatcaacgttaaatgacaggcgcaacaagttgtccgggcaggcatcgaccaccaggacattttctcccaacatttgtaatgaccaggctaatgcggcggtgatggttgttgtccccacgcctccccgaaccccctgcaatcccagtacggccattcaccaatcccctacttttgttgcgcaaactctgccagcaacggccagcgttttaatgccgcggccaactgttcgcgttgggaaatatcggcataatcaatatcaggcagtgaaaatgcctgctttaacgccaaaatatcattctggaagatatagcctatcgcgggatcaggcagagtatctggttcattgttattcatttttcttgatccctatgaaataaccgtaccgttcatgagacaattctaactgtgagcatttcgtcggtttattgtttacggcgagacgggaatgtgctcactttttgactttccgttacgcaacagaaaaagttaaaaacgaaaagactaaaatcacatgtcttgtgacctgctaaattgattcacatgctaaatctgataagttttaatttcaatggtaggtttatttcttagctttcgctagtaaactgataatcagacaaaatgttgacatgagggacattgtggaccctgtattctctatcggtatctcatcattatgggatgagctgcgacatatgccagcaggcggcgtctggtggtttaacgtcgatcgccatgaagatgctatcagtctggcgaatcaaacaattgcatcccaggctgaaaccgcacacgtcgcggtcattagcatggacagcgatccagcgaaaatctttcaattagatgattctcaaaggccgggaaaaataacattattttcaatgctaaatcatgaaaaaggtctatactatttggcccgtgatttgcagtgttctattgatccccataattacctttttattcttgtttgcgcaaataacgcatggcaaaacattcctgccgagcggcttcgctcatggttggataaaatgaataaatggagccggctaaaccattgttcgcttttggtaattaattccggaaataataacgataaacaattttcattgttacttgaggaataccgttcactttttggtcttgccagtttgcgttttcagggcgaccaacatttgctggatattgctttctggtgcaacgaaaaaggggtcagcgcccgtcagcagcttagcgttcagcaacaaaatggttgctggacattagttcaacaccaggaggcggaaatccaaccacgcagcgacgaaaaacgcattctgagtaatgttgctgtactggagggtgctccgccgctatcggaacactggcaactgttcaacaataacgaagtcctgttcaatgaagcccgtaccgctcaggcggcgacggtggtcttttctttacagcaaaatgcacaaatcgagccactggcccgcagcattcatactctgcgtcgccagcgcggtagtgcgatgaaaatcctcgtacgggaaaataccgccagcctgcgcgccaccgatgaacgtttattattggcctgcggtgcaaatatggttatcccgtggaatgcgccactctcccgctgtctgacgatgatcgaaagcgtgcaagggcagaagtttagtcgctatgtgccggaagatatcactaccttgctgtcaatgacccagccgctcaaactgcgtggtttccagaagtgggatgtgttctgtaatgccgtcaacaacatgatgaataaccctctattacctgcccacggtaaaggcgttctggttgccctacgtccggtaccgggtatccgcgttgagcaagccctgacgctatgtcgccctaaccgtaccggcgatatcatgaccattggcggtaatcggctggtgctgtttctctcattctgtcggattaacgatctggataccgcgttgaatcatattttcccattgcctactggcgacattttctcaaaccgaatggtctggtttgaagatgatcaaatcagtgccgagctggtgcagatgcgcctgcttgccccagaacaatggggcatgccgctgcctttagcgcaaagttctaaaccggtcatcaatgccgagcacgatggtcgccactggcgacgaataccagaaccaatgcgactgttagatgatgctgtggagcgctcatcatgatgaccatcagcgatatcattgaaattattgtcgtttgcgcactgatatttttcccgctgggctatctggcgcggcactctttgcgacgcattcgcgacaccttacgtttgttctttgctaaacctcgttatgttaaaccggccgggacgttacgccgcacggaaaaagccagggcaaccaaaaaatgactcaatttacgcaaaataccgccatgccttcttccctctggcaatactggcgcggcctttccggctggaacttctattttctggttaagttcggtctgttgtgggcgggatatcttaacttccatccgctcctcaatctggtgtttgccgcgtttctgctaatgcccattccgcgctacagcctgcatcgcttgcgccactggattgccctgccgatcggctttgctttgttctggcatgacacctggttgcctggcccggaaagcataatgagccagggttcgcaggtggcggggttcagtaccgattatttaatcgatcttgtcacacgctttattaactggcagatgattggggccatttttgttttattcgtggcctggttattcctgtcacaatggattcgcattaccgtttttgtggttgccattctgctatggctgaacgtacttaccctggcgggaccaagtttctccttgtggccagccggtcaaccgacgaccactgtaacaacgacgggtggtaacgcagcggcaaccgttgcggcgacgggtggcgcaccggtagtgggtgatatacccgcacaaactgcaccgccaacaacagcaaaccttaacgcctggctgaataatttctataacgcggaggcgaaacgtaaatcgatcttcccgtcttcgctgcccgctgatgctcagccatttgaactactggtgattaatatctgttcgctttcctggtcggatattgaagccgccggattgatgtcgcatccactgtggtcgcatttcgatattgagttcaagaactttaactccgccacctcctacagtggcccggcggcgatccgtttactgcgcgccagctgcgggcagacttcgcacactaatctgtatcaaccggcaaataacgactgctatctgtttgataacctgtcgaaactgggctttacccagcacctgatgatgggacataacggccagttcggtggttttttgaaggaagttcgcgaaaatggcggcatgcagagcgaattgatggatcaaacaaatctgccggttattttgctgggctttgatggttcgccggtttatgacgataccgccgtgcttaaccgttggctggacgttaccgaaaaagataaaaacagccgtagtgccacgttctacaacacgcttccactgcatgacggcaaccattatccgggcgtcagcaaaacagcggattacaaagcgcgggcgcaaaaattctttgatgaactggacgccttctttactgaactggagaaatcgggtcgtaaagtgatggtggtcgtggtgccggaacacggcggcgcgctgaagggcgacagaatgcaggtatctggtctacgtgatatccctagcccgtctatcacagacgtccccgttggggtgaaattcttcggcatgaaggcaccacatcagggggcaccgattgtcatcgaccaaccgagcagcttcctggctatctccgatctggtggttcgcgttcttgatggcaagattttctccgaagacaatgttgactggaaaaaactcaccagtgggttgccacaaacagcaccggtctccgagaactcaaatgcagtagttattcaataccaggataaaccgtacgttcgcctgaacggcggcgactgggtgccttacccgcaataagaacgaaaaaggccgcagagtttcacccctgcggcctgatccgggcgcaaattgccattacggcagcctgacgcccgcatgacacgttacttccgcttattcagccagttcacgatcatactggcaagaatgccagcaatgaccggagccgctaaatcatgccagaaggccatgcccagttctgcgagcgtcatatagccgcctgtgttgtaatgacaacgtttcgcggctattcttgagtggtctaggttcaagattagcccccgtgatgttgtcaggtgcatacctgcaacgtgcgggggttttctctctccagcaaccaatgccaccagggataaagcccccgcaacattgcgcctcaccggaacccttccggcttgccgctgattttacgattgttttttgccgtcagcacccggcaatcttcctcattgcgtgatgccttccagcttaatttctttatttgcaatagttgcagctcatatccgggctgactccagactagtagtgaaatgcgcaattttgtagaattgcgcctcctcgcgacctccccagtgaatctgttgcctcattttttacatactgcgtattcgacttctccacctgttgcgcaagagaaactgggtttattcatttttgcgaggccgacttctttctggacaggactttatgcagcacaacacactaccgaaacacgatcagaaattgccgtttacacgctacgacttcggctgggttttattatgcataggcatggcgattggtgccggaaccgtgctgatgccagtacaaattggcttgaagggaatttgggtatttattaccgcagcgatcattgcttatcctgccacctgggtagtacaggacatttatttaaaaaccctttctgaaagcgattcctgtaatgactacaccgatattatcagtcattacctggggaagaactggggaattttcctcggggttatctactttttgatgattatccacgggatttttatctactctctctccgtggttttcgacagcgcctcgtacctgaaaaccttcggtttaaccgatgccgatctttctcaatctctattttataaagtcgccattttcgccgtactggtggcgattgcgtctggtggtgaacgattactgtttaagatttccggaccaatggtggtggtcaaagtggggattattgtcgtgttcggttttgcgatgatcccgcactggaatttcgccaatataaccgccttcctgcaagcctccgactttttccgcgatgtcctgcttactattccattttgcttcttttccgcggtatttattcaggtacttaacccaatgaatattgcctatcgtaaacgggaagcggataaagtactggcaacccggctcgcgctgcgtacccaccggattagctatatcacgctcattgcggtgatcttgttttttgccttttcgtttaccttctcaattagccacgaagaagccgtttctgcctttgaacaaaatatctcggcactggcactggccgcgcaggtgatccctgggcatatcattcatatcacctctacggtactgaatatctttgccgtactgactgcattctttggcatttatctcggtttccacgaggccattaaaggcattattctcaatctgttaagccgaattattgataccaggaaaattaactcactcgtgctgactctggcgatctgcacttttatcgtcattacgttgacgatttgggtttcgtttcgtgtatcggtactggtgttctttcagttgggaagcccgttatatggcattgtgtcgtgcctcattccgtttttcctgatctataaagtctcacaactggaaaaacttcgcgggtttaaagcctggatgattctgctgtacggcattttgttatgcttgtcgccactgttgaagttgattgagtaaaccggagcgcatggccccggttttgtgagttaacgctgcggattttcatcctgatcaacggcaaaacaggctaccagttgaccgccgtagtcttttagctgcggctgcaactgggtgcaggggccgaagcgccgacgacagcgggcgttgaaggcgcagcctggcggtggattcagcgggcttggcagttcaccggtaagtttgatgcgttcgcgacgatcgtccgggttcaggcgtggtgtcgcggagagcagcgcctgagtgtacgggtggcgcgggttattgaagatttggtccttcgtccccttctccacgcagcggcccaggtacatcaccatcacttcatcagcaatgtgctccaccaccgacagatcgtgcgagataaagacataagatagccccagttcctgctgcaaatccatcatcagattcagcacctgcgcacgcactgagacgtccagcgcggaaaccggctcatcggcaatcaccacatccgggtcgagcatcagacctcgggcaatggcgatacgctgacgctgaccgccggagaacatatgcggatagcggtcgtaatgctcggttttcaggccgactttcgccatcatcgacagggctttttcccgacgctgttctttgcttaagctggtgttgatcagcagcggctcttcgagaatctgcccaacttttttacgcggattcagcgaaccgtaagggttctggaagacaatctggattttctgccgacgtagcttctgcgcctgcggatcgtgcttgagcagatcctgcccctggtaatacagttcgccgccggtgggcgtttcaatcatcgtcagcaaccgaccgagggtcgatttaccgcagccagattcacctactactgccagcgttttgccacgttcaaggttaaacgaaacgccatccagcgccttcaccagacgttccggcgcgaacatgcctttcttcaccggataatgttttttcaggtcgatagcctgcaacagcggttgttgcgaggtggcctcatgcgtactcatagtgtcggcctcccggcatcatcaagtgggtaatggcatttggactgacgcccgtcagcgagcatattcagcgccggttcttcagcacggcatttgtcagtggcgtaggggcagcgcgggttaagcaggcagccgttcgggcggtcgtacttgccgggaacgacacctggcaacgacgccagacgttctttgtcctgagcaaattccggcagcgcacgcagcaatgcctgagtatacgggtgacgcggcgcatggaagatagcgtgcgcatcgcccgtttctactacctggcctgcatacatcacgataattttatgtgccgcttccgccaccagcgccaggtcatgggtaattaacaccagcgccatgttctctttctgctgtagctccagcagcagttcgataatttgcgcctgaatggtcacgtccagcgcagtggtcggttcatcggcaatcagcagttttggtcgacaggcaatcgccatggcgatcatcacgcgctggctcatgccgccggaaagctgatgcgggtaaacatccagacgcgatgccggatcgggaataccgaccagattcagcaggtcaatcgctcgctgacggcgggtacttttgttgccgccttgatgcaccttaatcgcttccataatctggaaacccacggtgtagcacgggttaaggctggtcatcgggtcctggaagatcattgccacttcggcacccaccaggttgcggcgctctttttctgagatacgctgcaaatcctgaccgttaaactccagcttttccgccattacgcggcccggataatcaatcagccccataattgccagcgaactgaccgatttaccagagccggactcacccacaatcccgaccacttcaccctgttttacgctgtagctgatgcggtctacggcgcggaacggtgcgctttcgtcgccgaaatgcaccgataatttatctacatttaataacgccatctcgaacctcttactgcttcagtttgggatcgagcgcgtcacgcagaccgtcacccatcaggttaaatgccagcaccgtcagcaggatcgccagacccgggaaggtcacgacccaccaggcgctttgcgcgaactgcaacacgtcagagagcatggtgccccactccggcgttggcggctgcgcgcccatgccgaggaaaccaagagcagccatatcgagaatggcgttagagaaaccgagcgacgcctgaacaatcagcggcgcaaggcagttcgggaagatgttaataaacatctggcgcattgccccggcacccgccacgcgagacgcggtgacgtaatcgcggttaacttccaccagcacggcggcgcgggttaagcgcacataatgcggcagcgcaacgaaggttagcgccagcgcggcgttaccaatcgacgggccaaaaatcgccaccagcaccagtgccagcagtagacttggcagcgccagcatgatatcgaccacgcgcatgatgatgttatcgaccagaccgccaaagtaaccagcgatcaggccgagaataacgcccataatcagcgataacaccactaccagacagccaaccagcagcgacaagcgcgcgccgtacatcagccgcgacagcacatcacgccccacgtcatcagtgcccagcaagtgcgccatgctgccgccttcctgccaggctggcggggcgagcagtgcatcgcggaactgttccgctgggttatagggtgcaatccagttggcaaagatcgcgataaacagcacgatgacgacgtaaaccagcccgacaaccgcgcctttgttgcgtttaaaatagtgccagaactcctgtaacggggtcatcggcaccggtgcgctaatcactttattttcagtaacctgtgacatgatgtccccttacttcttatgacgaatacgcgggttcaccacgccgtacagcagatcgaccagcaggttgacgaggataatcatcgtcgccaccagcaatacgccgccctgcactaccggataatcgcggcgttgcagtgcgtcaatcaaccagcgccccagaccgggccacgagaagatggtttcagtcagaatcgcccccgccagcaatgttcccacctgcaggccgataacggtcaccaccggcagcatcgcgttacgcagcgcatggacgataatcacccgcatccgggtaagacctttggcacgcgcggtgcggatataatcttcgcccagcacttccagcatcgaggagcgcgtcatacgcacaatgaccgccagcgggatggtacccagcacaatggcgggcaggatcatatgggcgacggcatcgataaagttaccgtcttcaccccagatggcggtgtcgaccagcataaaaccggttaacggattggaatcatcgaggaacaccatgtcgctcacacgaccggagacaggcgtcaggttccagtgcaccgaaaccagcatgatcagcatcatgccccaccagaaaattggcatcgagtagccggtcagcgccaggccaaccgctgtgtgatcgaaaatggaaccacgtttaaccgcagccagcacaccaaccggaatcccgactgcggtcgcaaaaatcatcgcgcagacgccaagttccagcgtggcctgaaagcgcggcacgaactcttcccataccggaattcggcttttcatggaaatgcctaaatcaccgtgcattacgccccaaatgtaatggagatactgctgccacatcggtttatctaagccgagttcagccagcaattgcgcgtgacgctctggggagatcccacgttcgcccgccatgatcatcaccggatcgcccgggatcatgtggacaaaggcaaatgtgagaagggtaataccgataaacgtggggatgacgagtcccaaacgtcggagaataaactgcaacataacccggattctctatagtgacccgcagcctggaactgcgtgtctgtattgctcacaaatcaattcccgcccttgtggaacagggaatgaagtattgctgccggatggcgctgcacgcagaggcacagcgccaccgggtatgcagattgttgacaaagagcgctttgtttatgccggatgcggcgcaaacgccttatccgacctacaaaatcgtgcaaactcaatacattgcagagttttcgtaggcctgataagcggagcgcatcaggcagttttgcctttgccatcagtcttgcatggctttaattattcgatagagacattttcgaagtgatgtttgcctaatggatcaaccacatagcctttaacttctttgcgtaccggttcaaacacggtggagtgagcgatgatcagtgccggagcctgatcgtgcatcacgacctgtgcttgtttgtacagttcaacacgtttattgtggtcgtcggtagcacgcgccggttgaatcagatcttcaaacggtttgtagcaccattttgagtagttggagccttgttcagaggcggcgcagctgaacagggtggcgaagaagttatccggatccccgttatcgccagtccagcccatcattaccgtctgatgctcgccatctttcgcacgcttgaggtactcaccccattcgtaggtgacgattttggcctgcacgcccactttcgcccagtctgcctgaatcatctccgccatgcggcgagcattcgggttatacggacgttgtaccggcattgcccacaggtcgatggagaaacctttttccagacccgcttctttcagcaaggctttcgctttttcaggatcgtaagtgtagtcctgaacgtcgtcgttatagccccacatggttggcgggatcaggtttttcgctgatacgcccgcgccctgataaaccgctttgatgatggcgtctttgttcaccgcgtaggtcagagcctggcgaactttcacgtcatccagtggttttttctgcacgttatacgagagataaccgacgttcagccccggcatttccatcaggttgatggatttatcctgcttcatgcgggcgatatctgccgggttcgggtacggcatcacctggcattcgttcttctgcaatttcgcgtaacgcacggaagcgtcaggagtaatagagaagaccagcgtatcgatcttcggtttggtgccccagtagccatcaaacgctttatagcgaatacgggaatctttctggtactgctgtaactggaacgggccggtaccgattgggttgaggtccagtttttccggtgtaccggctttcatcatcgcgtcagcatattcttttgacagaatagaggcgaagtccattgccaggtcagcgaggaacggcgcttccgggcgagtcagcacaaactgaacggtgttatcgtccacctttttcacttcgctgatcagctctggtaagcccatgccttcgaagtattcgtagctgccgccagagactttatggtacgggttttgcgcgtttttctgacgatcgaacgagaacactacgtcatcggcattcagttcgcgcgtcggtttgaattctttattgtcgtgccacttcacacctttacgcagatggaaggtataggttttaccgtcttcgctgacttcccacttttcagcgaggcccgggatcacttcagtggtgccgattttaaattcaaccagacggttataaagcggtacggaagaggcgtcataggtggtgccggaggtaaacagctgcgggttaaacccttccggagatccttctgagcaataaaccagagttttagcctgaacacttgctgcgacggtcatagccaccaggctgagaccaagcttcagcatccctgactttttcaaggaaatacgcattattctgctccaattgtgatgtttgttgttttaaccctttgcagtgggttgtcgctgcctgaccttttttgttttttgcccggtcgggtcaacgttatgaggtggggatgccgtactaattaacatcagtgtaacagtgcggatcctccataaaatgcccctcgtgacctacaatctgtcaacagaatgtgaaaacgtcaatacagccaaccgggatttacaccaacggtgagaatccacaaacaaagattaaaaaaacttcaaacagctatttgcagcagagaaatttgtgctacgccaacacaaccagaacaatcagcttaatatttagcaacatttggtgattaagttttatgcatttaatgaaaaaaatctgaggtaaaggtggatatctgagcgattaataccatgaacgctaaaacgcacagcggaaaatgccagcgccagccataagtaacgcaaaaaaagatttaagcaaatataaaaaaagacaatggtttctgtcacaaatccgttaatggatagtgagatatggggcgcaaatttggcagggaaatgtgtggtgtgtaggtcgaataaggtgttcacgccgcatccgacaatgggccggcacatttgcctgatacgacgctggcgcgtcttgtcaggcctacgtcgaatcgaacctccccgcccccggaggttctcttcctcatgagttacagatgcaaaaaagcctgctcgttgagcaggcttttcgaatttggtcggtgatagaggattcgaacctccgaccccttcgtcccgaacgaagtgcgctaccaggctgcgccaatcaccgaatgcggggcgcatcttactgcgcagatacgccctcgtcaatcccttaatagcaaaatgccttttgatcggcgagaaagtcagcaggcctagttagccgacgcctcttttgcctgcgggatgtgacaccagttgttgttttcgttaattccaccatccggtgaagtatagccaagacaacccatgatggtgtcgtacagctctacatgacggcgtggcactttcatgtcggcttcttttttcagctgcgcaaatgcctgcgcattgaccggattttccagatatttatccgacatccagaccatcatcggcacacggaactgttccggcggtgccagttcacgcggcgtgccgtgcaggtgctcgcgttcattaattgactcaccgtggtcagctgcatagaacacaatcgctttcttatcgcgaacctgatcaatcacgctggaaataaagtgatccacataggtcaccgagttgtcgtatgagttgatcatctgcgctttggtacagccgctatcaacaccaatacattccggcttccactgcgcaaagctgcgcgggtaacgctgggtgtagttaaagtgtgagcctttggtatgcagaatgatcagatgcttaccatccgggttgcgccccagcgattgctgcatttcgtctaccagcaacatatcatctaccggtttgccacggttacgtggctccgcaccaatctgctcacgataagcaatgttgtccgccatcgtattgctgtagaaccacatttcgctttgcatagcgtagagatcagaactgaatcctaactgcttcaataccgcgaaaatgttctgttcttttaatgtgcgctgcggattatcttccgcgccaccctgacgtacaaacatgcaacgcagtgagagtttggttgcagtatcacaggagtaaccacggaacgccgccagatttttctcctgagccagcttcggtgtggtattgcgttcatagccgaaaatgcccatatgatcccagcgcgtggtttcaccaataatgaaaacgacatatgtatcatcaacgttttgtggagcctggtacgtaaacttcttcgcaggattaaggagagaattgttatcggaagattcatcgacccgcgcccaggcataaagacctaatgccgaaagccagtttgatggcagataagagttcgcgacgacgccgccataactcggcaaatcaacacctgtcgccctctccactttcttctgctggatatccagcaaacgaatcggtgcccaaaccataatacctgccagtacgacgaccgccaggctgcgaatacgttgccctggggttcgcagttgtcggagcaaggtgtaacgacagcggttattccagataaggataagaggcaacgcgcttacggcgattaaccagagaataaagttcagaccaacaacttcttttgacaggtcgatatcggtggtcatgacggatgcgatgatgccataaccaatgactacattaaggaaggtcatgtaatagctggcacctgcggaaaagagcaccaccagcgatgccagaatacgccagctgcggcggccaaacagcgaaagaagacgcagtaaaaagaaggtcaccagtacggtggcggccagttcaacaacagcagaaatacctttccagacggtaaaatcgtgcgcatagctgccgaagcggcggtaaaaaaccgcgccattcataaaaaggccaatatagattgcaagcaagaagctcagcttctgctgtgtaatcgatttgatgtatctcatgcaaacaagccctggacaaacaggtgataacaccctgcttagtggcttttcaggccaggcaggggaaaagtgcggaggtagtcagataagtaaaatctacacgcgcgaataagtagaccacagcaaagggaaaaagtgtggggaaagagtgtgcacgaagcacaaatttacaaaaatgcaagtttgaaaagagactttagcgttacaaaaagcagtaaaaagggccagtgagctagccccggtgaagcgaaattattcgtactgaaccgtaaaatcgaccgtcgcatctgcgcggccaatggttgcatcagcacgcagcggcacgtagctggcgatatagttcagttgatgcgcgccatcaccgttaatcgcgaactcaatcggcgtcggtgtcgtatttttcgggaactgttgtactcccgcagaggttttaattttcaaccccacgcccgtagcaccacccgcgtccagcgcaaaaagatttggatcgtccgcattgggtgttccatccatggtgacgtaagccctgacaacttcgctacagtttttcagaccgatggaaaaagtagtgggattaagttctgttccgattcttactggctttttgagaaccgctaatcccatgtcaacttcaacactgtcttttaccagttcacaggctccctggctgattttaagagagaatttcaacgttcctttcgcccctaagtctgtggttgccgacagtgacgaaaaggaaaaaggtagcaggcataatgcaagtattgttcgtttcatcagtgctaatccaattcaacatgcattgttgccacaccgctataatcaccggctgcgggtaatttcccggttgtactaaccggataagcagtaatggtggttgttactttacgtttgacatattcgtacagtgagccgggattcatttctaataagctattactatcattcggcttaagaatattacctttaccatcctcaattaccgcaccaacatccgcgttgcccaaactgattgcgctggggtaagccgcgtttggcgtaccttcaagactcagatagatatggacaccatcagaaatattagtacagttaaacgttaattctttttgtattttctggacattttgtggcggctgcccggttcgacctttgaaatcatgggcctgatactcaccaaagtcgatatccaatgatgtccctgcggcaagttcacagccttgagttacggtgacctttcctgaaagaagcacctgtgatattggaactgaactataaacattctccttttttgtaccaaacacagaaactataatagtttgcggaatgttttgttccccaacaaaaggtttagcgatataaagtgagagctgtcctttactccctgtagtccagccaaaagttggttgatcgcactctcttcctggctggctatttgatttattgataaatggaacctgtacattccccacgtttgcaatatatacccgggttgggtaatgctgccaacttactgatttagtgtatgatggtgattttaaggtgcttgcgtggcttccatttccatcagatgtccttcctgctccgctactgaaggcgtggtgcgtaacggcaaaagcactgccggacatcagcgctatctctgctctcattgccgtaaaacatggcaactacagttcacttacaccgcctctcagcccggtacgcaccagaaaatcattgatatggccatgaatggcgtcggatgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacagtggggctacgtcggtgctaaatcacgtcagcgctggctgttttacgcgtatgacaggatacggaggactgttgtggcgcacgtcttcggtgaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaagttggagtcattacccccgggttgaaacctcaagattattggtaattttaaaataggttgagttatgccccgccgccaatgttgactcagttttatatagcgttggtcgtgcttctgtcgggttcggtgatggacattcacaaacaccagaatatttatcacccagtgcccattggtaaaaatcagggtaggtctgcccggtaacattatccgtcggattttgaatatttttggtgaatgatataacaaaaataaaggggtcaccacttgccgtcctgcacggcccccaatccgcagcccatatattcccggtaaaggtgctcgtccctaaaagcaccatacctgccaacaagtttttaattttcatctgcatatccttatttatcgcataccgcattaaccatcacgatacccgaattatcctttttctctggcaagcggaatggcacgcggcaacgttgcgcctgctcgtgcccccagctcacctgcaattcgccctcttctggcatcccgctgatataaagctgtccttcttcacccacaatgctgctggcaggtttgctctcatcacttaacgctgcggtagcaccaaacggtactgcgttgccattcgcccgtttcaaactcatcagcacacgataaccgacacgcgtatcaaagcgggaacggactatcgccccacgcgttggaacgactttctgaaacgcttcctgtaattcaacgttttgccctaacgtgtcgctgcgcaattccacaatggtttcacgatatggcgtgagatacggcaccactgcgttgcccatccagtcaacttcaacgccgctgctatttactacatgtccaccacgcgcacccggcgcagaaacaattgccagactttcacccaagggttgcgagagagtgataccttcactgtgaacaatgactccaccacgcacaccatagttaacttgttggttatctttggaatagttataacccacgtcaatgttgccagaacctcccatataacccatgttgacactaccactgttgccaaccccattactggtataaccctgctgaacgttatagttcaagttacgatcttccagtaatgtgccgctgacagaggcctgttgtgacgtcttgccgttctggtcggtggtcatacgataactgccccatgcgccacccagcggtattgagaggctaaatgaccacagtcgatcgtcttcatcccattcagggcttctcgtccaggtataggcgatactgtaattcacacgaccaatatgaccgtgataaccagcgcttaaggagttctccttaccatcaacgttccagtaatcctgctgcgtcatattgaagtaaacagaaccgtagtctcccagttgctgagtgatgttaccttgtatctggctgcgcttatgataacgccgatagtcactgtcggcgtcactacggacatcggtcgcttcctggaaggtgtaataaccgctggttgagtacttgtagcccaacagacgcaggtcggtaccgccctcaaaacttttcgaatagaggaaacgataagactgcccttcatctttttcattgttgcgtaactgacttttcgcctgggtgacatccaccgataccgcaccaatggtgccgaagtttttccccagccccagagctaaagcgttgtagtctgccgatagcaacgcaccaccataggcggtcattccccacggcaagccgtacatggcagtaaattgcccgaatcgcggtttaccgctgtcgtaattaccggcacgatactcaccggcagcaaggctgtatttcagatacccttcacgctggaaaatcgccactgccgaaaatggttgaataaaacgttgttcacttccgtcagattctttaatgatcaccgtcaagtcaccgctgccggaggttgcgtagagatcgttaatctcaaatgcgcccggctgaacaaaggtacgataaataacatatccgttctgttcgatactcacttcagcgttacttttggcgatgccacgcaccaccggagcaaagccacgctggctatccggcaacatttcatcgtcggatgccaataatgccccgcgcatttgtacgctatcaaaaatctcgccaggcgtggcggtatcacccaatgttatctgtgacttgagtggaataatcgcccggtttaacgatgtaccaacgttatcccattgatttttgccatcggtacggttccagatactgttattacgtaaacgccacggccccacgttcaaaccgctgcgcaggttcaggtaataactgtcactggtcgaatctggagatgaaccggaaccttcgttgcgaccattgctgccactaaagctgtagtccagtaacagcgcaggtattccttcgtcccagcgagaaggatcaaccgtgccacgagcggtcatcatcattgctgcctgtggaaaggtaagatgcaacgtctgagtattaaaatcaaaacgactggtggcctggggaatgatttcatcaaacgctacgcaggcttccggtggcaatatcttcagtgccggaaagctgtcgacgcgcacgcccatttcttccagttgaacacggctaaggcaaggcataagcgactcgccgctggctttgcgttgtgcttcgctggcagtactaaaatccagcgtccgggaagccattttttcttcgtttacaaacacaaatacccgatatttaccgggtatttgctggccgacaggaaagtcgtaaactgacaaatcgacgtgttgatcaataccctgaacattttcaagaaatttagggttgaattttccgccgtacgcaggtaacgcgctggcaatagttaatgccaacagtgagaaagaaaaatgcgctctgtagtgatcaagaggtaaatgcatccaatgcatagtaaagcgccttgtaaaaagatcagttaatcgacttcgtcagcatttcaccggcgacaccgaaatcattaataatgctgtatttcacttcgttcgcattgcctgtaccggctggaaggttaatgtttaacgttcctttagcgaggaccattcccgcccgttcaatcttttgtccattaatggacatctgattaaaggtcaggttataagctgagtcgttattaaccacaatttggttattttgacgctgaaatcgtaactgtttcattgcttcaaggttgcttcccggcaagcctttcggacggtagaacaacttcaaacgggtgcgaacggctatctgtaagacgtttttattttcattttcagcacttttcgcaggaatcgcttttacattaatccagtaaacggattcacgatctttgggtaaggtatcttcaatattaacaatacgtaagacgttatttttatcaggatcaagtttgaataatggcggtgtaataataaacggcgtttttttatttccattcacatcatcaatccatgactggatcaaaaactcttcatttttattatggttttcaacggtcagcgacgcttctttcttgccaccatcataaataacgcgcgtcgtgcttagggctacgccgccagcaaaacactgttgtgcggtcattaaaagcgccagaacggcaaggctaattcgtttcatgattcggtccctgagtcattggtgtgaataatggcaacagataatctgttgccattgagagataatcgttccgtctggatcgattagttgtaagtcaggttgaagtcgacttcggcattaccgtaaccgatggttactgcatttttggtagcgacatagttagcggtaaaatacagaacagtctggccttctttcaggacagtagcagatttaccggtattcagatcaaccagcgtattggtattatcataaataccaatacccacgccagttgcggcacctggttcagtgcttacagaaatcagtttgctgttgtctgcgtcgccaacaccgttaaagctgatctccacatttttgaaagtggagatatcgcagttttccagtttgattttgaacggagttgctgcggatttatcaccagtagtggtaaacacagacttgttcacctggcccagaacaacttcttgtttttgagtgtctggagacacaacacaagcggcgtcaacaatctctccggtaaatttaacagaaccgtcgcctgcatcagctgcgaatacggaagtagaggtcagcgcaagcgcagataaggcaaacagaacctttttcatttataactccatttatatagataaatatgcttgatgttgttcatacaacgggtcgcagattatacaaatggcgttaaaaaataaaattatttttactgaatattaatttttgcaataagttgaaatatgcttcaacttcaatcaattacacataaaacgcaatttaattaccgtttttttaagaaaatatttatatttacataaagaatgtataaacgaaaaatattcattttttggatgccattgttcttttaacatgcaaccataaaaaagggagacttcgaagtctccctcatcgtatttatttcagcagcaacatatttctaaatatgtgcttcacgcaacattttctgctctggctggcgaatggtcgtagaaagcgccagtgacagaatcagcagggcgaaaatcacgtagaaagtcacatagaatccgccaaacagtgaagcgataatcgaaccacaaatgctgccgataccgaaaccgaggtaaatgacgccgtagtttttcgccaggttattgaggccgaagaactcactgaccagtgacgggaacaccgtaatcgtgccaccaaagttaaatgccacacaggcaatcgctgcaaagaacgtcactgcattcaatggtgcaaacagcagggccgccatacccaccagcgcaatcacctgaccaatggtgataacacggatacgggcgattttgtcagacagaatgcccagcaccagacgaccagaaaggttggcgatggaaataaccgtcacagcattggctgcggaaattgcatcaagatgcgccaggctttgagcgatatctttcgctacaccaatcacatacagaccactcatgcacgcagtcaggaacataaccgctaacatccagtactgcggtttacgcatcgactctgccagggtgtagtccttctccaccacaccattgctggttttcacttcctgcttcggcgcatctttcattaacgttgcgccaaagacaatcatcaccagtacaatcgcgccccaaataacaaaggttttttccagacccaccgtttcgagcaggtgcgtgtcgataaatttaaaacccaggctgcccagaccataagaaccgatagcaaaagcagagataagtcccttacgctccggaaaccacttcacgcagttagagagcgtcaacaggtaacccgcaccatccgccagaccaaccaacacaccggcgcttaaccacagcatcatcaggttgttggaatgtgctgtcaggaagaaacctaatcccagcaaaatgccggaagccatagtgacgcgtttaacaccaaaacgttcctgcaatttgcccgcaacagaagacgaaattgccagccccagacttaacaagccgaaagagaaagcaacctggcttacaggagcccccagcttggcagaaagcgcaccgttaaacagactccaggtataaaccgaccccagagcaaactgggtaatgatagtaccgatgagtgtcagccagcgagtacgctgataatttgaaggtgtcatggcagtattcctgcagtaataaaaaggaaaaatctctgctgacaaccataacgaagtgcgctttatgcctggggaaaaacggcatgaaatgccatcagaacggaatgaaatgcattagttcaggaatgaatgactcgacaattattcgccaaatttattatttagtaagttagtccccactatcaccacattagttgttatttatgggtttcaattgtatctataacgttaaaatctggcactaacccccatcgtatacagatagtcgctattgttagtggtattttctgcctgagatagcgcagcataggcagcaatattttgattgagcaacatatcagcgcctacggtgacatccagccagttgccgttctggtttgtcgccgtcatccggctcaggcctgattgcgccttccagatattctcgccaaattgctggttatagctgatttgcgcccagggtcgaagatcgccaagccgggagtcaacacgccagcctaaggtactcacgctggcatgccataacggatcggccagcgtggtagtactgtcgccaaactcgttatacatcgaggtagttgtgccatcgtaatgtaatgccgcgaccgggccggttgtaacctgctcatataaaggaaaattccagcccatactcatactgctggtcacatccacaggggtttcttccgccagattgacttccagtcccagcgccctttggctactttgaatacgttgcgacaaaatatcgttgtaatcaggttgatgatcgctatcccaggtgtaacgctctgtgaaatgtccgggttgcgtatcaacgatatattcttgttgccaggcgtaagctgtgttgagaaaaaaggcactgattaccacgctcgcaagcaggcttagctgccagcgaccaccgcttttttttatgatcattaacacgactccagggaagagccgaattcggcaatattattgtcattgtatgaaggatatcgggcatagtagccctgtattaaatattgactttttcaccgatgcgtcaagaaaagcggctgaaatttttacgatcgggtacatagcgagggaaagtatggaacgttgcggctgggtgagtcaggacccgctttatattgcctaccatgataatgaatggggcgtgcctgaaactgacagtaaaaaactgttcgaaatgatctgcctggaagggcagcaggctgggttatcgtggatcaccgtcctcaaaaaacgcgaaaactatcgcgcatgctttcatcagttcgatccggtgaaagttgccgcaatgcaggaagaggatgtcgaaagactggtacaggacgccgggattatccgccatcgtgggaaaattcaggcaattattggtaatgcgcgggcgtacctgcaaatggaacagaacggcgaaccgtttgccgactttgtctggtcgtttgtcaatcatcaaccacaggtgacacaagccacaacgttgagcgaaatccccacatctacacccgcctccgacgccctatctaaagcactaaaaaaacgtggttttaagtttgtcggtaccacaatctgttactcctttatgcaggcatgtgggctggtgaatgatcatgtggttggctgctgttgccatccgggaaataaaccatgattcggggagcgcaacattcagaactccccgcgatcctcgaactgtggctggaaagtacaacctgggggcatccctttataaaatcgagttactggcgtgactgcattccgctggtgcgcgatgcgtatcttgccaacgcgcaaaactgggtctgggatgaagacggcaagcttctcggttttgtcagcattatggaaggccgattcctcgcagcaatgtttgtcgcaccgaaggccgtcaggcgcggtattggtaaggcgctgatgcagtatgtgcagcagcgccatccccatctgatgctggaggtttatcaaaaaaatcaaccggcgatagatttctaccatgcgcagggttttcacattgtcgattgcgcatggcaggatgaaacccaactacccacctggattatgagctggccggtggttcaaacgctgtaagtgtcagttccggaccgttgtatttttccagccatgccagcgccgtattacccgcacagccattccccagccgcgagctggggagatctttggtcagcacgttcactgcgccgtttttacaaatgccgtcagcggttaaatccagatctggccatgcgccttcgtgaatacaaatcacgccaggtttaattccctcgctaatgaccgctccggcaagaatttgcccgcgtgagttccacagccgaacagtatcgccatcttgtatgccgcgcgtctgggcatcgtcaggatgaatggtgacaggctcacgatttgccaccgcgtacaattcgcgcagagaactgtaattcagctggctgtgcagacgatgcgccggatgagcagaaagtacctgcaactgttccggttcggcattgccctgccattcgtccggcgccagccacattggatgccccgggcaatccggataagcgtaatcggcaatacgctgcgagaagatttcaatcttaccgctggcggtttttaatggatgcgcctgcggatcgcggcgaaaatcggcgaagcgaataaaccgctcactgtccgggttttccggcatctcaattaactggttggcttgccagaactcagcaaatggcggcaattcaacctgctggcttgccccgcgctgccgggcaacgttataaaacgtttccagccattgcagctcactttttccttccgtaaaacgtgcataaccgcccttctgccaacgttcactcaagtcggcaaaaacatcaaaatcattacgcgcttcatcgcgtggcggcaccacttgcttcatcggcaccagatgctgattactgtaatcaccggtcatggtgagatcattacgctcaaaagaggtggtcgcaggcagaacgatatccgcgtgtttcgccgcagccgtccagaagcattcggagatcaccaccagctccggtttttgccaggcacggatcaggcgattggtatcctgatgatgagtaaagttggcaccgcccgcccaccagataaaacgaatatccgggaaatgtcggtccataccgttatgttgatatgcgccaccggggttttccagtgcttcaacaatgcgggcaacagggattttatccaccgcatcggtgccgccaggcaaactgccctgcatggaagagagcaccgcagcgcggcgcgtggggttaccaccattggcaaaatggtaagaaagaccaaaaccgccgccgggtgtgccgatttgccccaacattgccgccagcgtgacgatcatccaatgtttttgctcaccaaactgttgacgctgcattccccagccagccatcagcatggtggtattttggtggaaaagagccgccagctcgcggattttcgctgcgttaaccccacaaatccctgccgcccattcggcggttttcgctattccgtcactctcgcccagcaaataagaggcgaagacggcataaccggtggtgcaacgcgccagaaacgcttcgtcgtgccaaccattttccaccagcgtatgggcgatccccagcatcagcgcaacatcggtgcccatgtgcggtgccacccactccattttatcgccaaagaaatcgacggtttccgatcgcattggatcaatgcagatcagctttttcccgctgtcacgcagtgcggaaaagtaagaaagcccctgctcatcggatgcattccacgcaattttcagcgtattgagtggattagcactccatagcaccacgacatcgctatgttccaataccaacggccaactggtttgctgttgataaacttcgctgccacccacgacatacggcatgatcgcctgtgccgcgccggtcgaataatcccccagatgcccagtataaccgcctgccagcgccatatagcgttgtaataatgtcgaggccttatgcagcacgccgtttgaacgccagccgtaggaaccagcaaaaatcgatgccgggccataagcctcacgaatgcgtttatgttgatggtgaataagctccagcgcctcatcccaactcacgcgaacaaattcatcctgcccacgaatgccttgcggattttccggtgacgcaagaaagcctttgcgcaccattggaaatcgcacccgcgtattgctgtgaacctggtcgcgaaccgcgctctgcaaggagttttccattcctgtggctaacgcgccacgcgagctaaacacggtttcgccgtcggtttcaacctgcatgggcccccagtgggcggcagtcagaacggaatatcgtgaggatgagttggccaaaccgaagactcctgaaaggttagatgtattgagcagttaaatattacttacaaatttccgagtattcccaggaataatcttcatgttcacgcggcataatctcccgccacggaacccgtggcaaagaataaaaaggttattaaggattaacaatgaagaaacgtgtttatcttattgccgccgtagtgagtggcgctctggcggtatctggctgtacaactaacccttacaccggcgaacgcgaagcaggtaaatctgctatcggcgcaggtctgggctctctcgttggtgcgggtattggtgcgctctcttcttcgaagaaagatcgcggtaaaggcgcgctcattggcgcagcagcaggcgcagctctgggcggcggcgttggttattacatggatgtgcaggaagcgaagctgcgtgacaaaatgcgcggcactggtgttagcgtaacccgcagcggggataacattatcctcaatatgccgaacaatgtgaccttcgacagcagcagcgcaaccctgaaaccggcgggcgctaacaccctgaccggcgtggcaatggtactgaaagagtatccgaaaacggcggttaacgtgattggttataccgacagcacggggggtcacgacctgaacatgcgtctctcccagcagcgtgcggattccgttgccagcgcgttgatcacccagggcgtggacgccagccgcatccgtactcagggccttggcccggctaacccaatcgccagcaacagcaccgcagaaggtaaggcgcaaaaccgccgtgtagaaattaccttaagcccactgtaatccctttcatgtcaggtgatgcagaaatcacctggcattcttcagttttccttcatcatatttcaggctaaggtgatcgccttatcagtgaatggagagaagcatgaagccgtccgttatcctctacaaagccttacctgatgatttactgcaacgcctgcaagaacatttcaccgttcaccaggtggcaaacctcagcccacaaaccgtcgaacaaaatgcagcaatttttgccgaagctgaaggcttgctgggttcaaatgagaatgttgatgccgcattgctggaaaaaatgccgaaactgcgtgccacatcaacgatctccgtcggctatgacaattttgatgtcgatgcgcttaccgcccgaaaaattctgctgatgcacacaccaaccgtattaacagaaaccgtcgccgatacgctgatggcgctggtgttgtctaccgctcgtcgggttgtggaggtagcagaacgggtaaaagcaggcgaatggaccgcgagcataggcccggactggtacggcactgacgttcaccataaaacactgggcattgtcgggatgggacggatcggcatggcgctggcacaacgtgcgcactttggcttcaacatgcccatcctctataacgcgcgtcgccaccataaagaagcagaagaacgcttcaatgcccgctactgcgatttggatactctgttacaagagtcagatttcgtttgcctgatcctgccgttaacggatgagacgcatcatctatttggcgcagaacaattcgccaaaatgaaatcctccgccattttcattaatgccggacgtggcccggtggttgatgaaaatgcactgattgctgcattgcagaaaggggaaattcacgccgccgggctggatgtcttcgaacaagagccactgtccgtagattcgccgttgctctcaatggccaacgtcgtcgcagtaccgcatattggatctgccactcatgagacgcgttatggcatggccgcctgtgccgtggataatttgattgatgcgttacaaggaaaggttgagaagaactgtgtgaatccgcacgtcgcggactaagccgcgactgcgtggagtaaagcccgataatcgctcgggcttttactctttattgggttgcagtaactgctgtagtccaggcctgattaaacgcctgatgttgtgccggtaatggcgcaatcagtttgttatattcacttgcctgctgtgaagtcgggaactggatgccatttgcgacaaagctcacctgagtaccttgctgagcaatgtagtctccaaccatcaccagttgttgcgtgaaagtttgtgccgccggaatcaacggttgcaatgcatcagctggcgtcgttaccactttggtgaatgcctgatcaaagaccggtttcaggtcatcactctgttttaacgcagagtgcgcagcatcggcctgcaacttcgcattttgcagctgttgcgccagcacacccagcgaaccgttcatttcacgcagcggaccgctttgcgtaacgtaatcctgcggtacgcgaattgcgttaacgctgtctacaaccgggcgcagaccggaatccatcgcctgattcacctgctgagaataaccatacagaatcgcgtaatcagagacaaaaggaccaaactgttttttctgatcggcagtcagggttggtagacgttcaccgctacgcatcactgtattctgcaggaagtcgataaacgctttacgctgatcgccttctttatcaaaacacccactcaggctaactaccattaataacgccgcaagaggcgcaaaccagcgagagcaggactttcctgtcgccattttcttactcctttcacccaaaaaaagcgcacaacgacacacgcgtgtatgacgtgacaaggatagtccaggacaggcttgcaggataccctttctacgtaatcttcctggtaaaatcatggagaaaatgaaacaaggttaatttgttgtttcattgttaaaaaatgatattgccgttgccttttttgtagccagagatttacgccttcgcagaacgttaaattttcgaaatctttacaaaccgggagtggtaagagatatatcggcatttatcagatcgttaggtggctataagtcacgctaaatgactggctgaatcgaatcatagtcagagtatgccctgacaacaccccgctgtgtctgtttttcccgactattcttaatgagcttcgatgcaattcacgatcccgcagtgtgatttgaggagttttcaatggaatataaagatccaatgcatgagctgttgagcagcctggaacagattgtttttaaagatgaaacgcagaaaattaccctgacgcacagaacaacgtcctgtaccgaaattgagcagttacgaaaagggacaggattaaaaatcgatgatttcgcccgggttttgggcgtatcagtcgccatggtaaaggaatgggaatccagacgcgtgaagccttcaagtgccgaactaaaactgatgcgtttgattcaagccaacccggcattaagtaagcagttgatggaatagacttttatccactttatttctgtttacggtcctgataacaggaccgttttccaaccgattaatcataaatatgaaaaataattgttgcatcacccaccaatgcgtggcttaatgcacatcaacggtttgacgtacagaccattaaagcagtgtagtaaggcaagtcccttcaagagttatcgttgatacccctcgtagtgcacattcctttaacgcttcaaaatctgtaaagcacgccatatcgccgaaaggcacacttaattattaaaggtaatacactatgtccggtaaaatgactggtatcgtaaaatggttcaacgctgacaaaggcttcggcttcatcactcctgacgatggctctaaagacgtgttcgtacacttctctgctatccagaacgatggttacaaatctctggacgaaggtcagaaagtgtccttcaccatcgaaagcggcgctaaaggcccggcagctggtaacgtaaccagcctgtaatctctgcttaaaagcacagaatctaagatccctgccatttggcggggatttttttatttgtttttcaggaaataaataatcgatcgcgtaatagaatctagtgttatttttgtgaagaataaatttgggtgcaatgagaatgcgcaacaccgtaagaaaggcgggaataatttcccgccgaagacgcttactctttcaatttgcaggctaaaaacgccgccagctcataactctcctgtttaatatgcaattcacacagtgaatctcttatcatccaggtgaaaaataaaagcgtgaaacaaatcactattaaagaaagtaatctatatttctgcggcattcccagccccctgtgttgatttccaacgagtaagaggctaaccttatggtgtctatgcatagaggggcctcactttgatttatagtcaggtggggcttttctctgtctgcctttcggtgaatacctgagacaaacagtctcaagcacccgcagctattctagcttaataagttcgtttcttctccttgatataatcctaaaaaaatctcatgaaattaatatatgagacaatctttattcagcagaagattattaaaggttgctgtattatttagcgataaaaaaagcctgccagatggcaggctttttaataacggcgttattactgcaacagcgaaatatccgcaacgcgcaggaacagttcgcgcagtttttccagcatggtcagacggttgatacgcaattctttatcatcaaccatgaccatcactttatcgaagaaagcatcgaccggttcacgcagctcagccagttcgaccagcgcatcctggtaacgaccttccgcaaagtacggctccagcttgtcacgtagcaccacaacctgcatcgccagtttaatttcttccggctctttcagagtagaggcattcacgcgatcgctcagcacttcatcagatttcgccaggatgttagatacacgcttgttcgccgccgccagtgctgcagctgcttccagggtacggaagtgcgataccgctttcatacgggcatcgaaatcagccggacgagtcggacgacgcgccagtaccgcctggatggtgtcaacggtgtaaccttcgtcctgataccaggcgcggaagcgaccgagcataaagtcgataacatcatcaaccacgttggcgttagtcagcttatcgccatacagacgcactgcttcttcggtcagcgtttgcagatcaaggttgaggttcttctcaacgataatacgcagcacgccaagtgcggcacgacgcagcgcaaacgggtctttgtcgcctttcggatgctggccgataccgaagatacccgccagggtatccatcttgtcagcaatcgccagcgcacaggctaccgggttagacggcaggtcatcaccggcaaagcgcggctgatactgctcattcagcgcgacagctacgtcttccgcttcgccatcgtgacgcgcgtagtgcatccccataacgccctgggtgtcggtgaactcgaagaccatgttggtcatcaggtcacacttagacagcaggcccgcacgggtagcgtggttaacgtcagcgccaatctgctcagcaatccagccagccagcgcctgaatgcggtcagttttgtcgcgcagcgtccccaactgttgctggaacaacacggtttgcaggcgcggcaggttatcttcaagacgttttttacggtcggtattgaagaagaactcggcatccgccagacgtggacgaacgactttctcgttaccggagataatctgctgcggatctttcgattcgatgttggcaacgaagataaagttcggcagcagtttgccgtcgttcgcatacaccgggaagtacttctggtcacctttcatggtgtaaaccagtgcttcagacggcaccgcgaggaatttctcttcgaatttcgcggtcagaacgaccggccactccaccagcgaagccacttcttccagcaggctttcgcttaaatcagcgttaccgccaatcttacgtgctgcttcttcagcatcggctttaatcttcgccttacgttcttcgtaatcggcgatgactttcccgcgctcacgcagaatttccggatactgatcggcattgtcgatagtgaattccggctcgcccataaagcggtggccgcgaatcacgcgatcggactgaatacccagaatggtagccggaataactttgtcgcccagcagcagggtcacggtgtgaaccggacgcacgaagtgcacgtcgcttgcgccccaacgcatcagtttcgggatcggcagtttcgccagcgaagtcgcaaccatattcggcagcagtgcttcggtgctttcacccttcacatgggcgcgatacagcagccattcgcctttatcggtagtcagacgctcagcctggtcaacggtaataccgcaaccacgcgcccaaccttctgccgctttgctcggtttgccttcagcgtcgaacgcctgggcaattgccgggccgcgtttttctatttcgcgatccggttgcgcctccgccaggttagcgactttcagcgccagacgacgcggagcagcaaaccattgaacggtgccgtgtgcgaggccagcgttatccagctccgcagtaaagttcgcagcaaaggactcagccaggctgcgcagtgcttttggtggcagctcttcagtgccgatttccaccagaaaagttttctcagacatagccgcctcttacttatctttgttgcacatcgggaagccgagggcttcacgggaagcgtagtatgcttctgccactgctttggtcagggtgcgaatgcgcagaatatagcgctgacgctcggtgacggagatggctttacgcgcatccagcaggttgaagctgtgggcggctttcagaatacgctcgtaggctggcagcggcagcggattttccagcgccagcaactgctgcgcttctttctcgtactgctcgaagcaggtgaacaggaagtccacatccgcgtattcgaagttgtaagtggactgctccacttcgttctgatggaacacgtcgccgtaggtggttttacccagcgggccgtcgctccagaccaggtcgtaaacgctgtctacgccctgaatgtacatagccagacgttccagaccgtaggtgatctcaccggtaaccggtttacattccagaccaccaacctgctggaagtaagtgaactgcgtcacttccatgccgtttagccacacttcccagcccagcccccaggcacccagcgtcgggttttcccagttatcttccacgaaacggatgtcgtggatggtcgggtccatgcccagctctttcagagaaccgaggtacagctcctgaatattgtccggcgatggcttaatgaccacctggaactgatagtagtgctgtaaacggttggggttttcgccgtagcgaccatcggtcgggcgacgagaaggctgaacataagcagccgccatcggttctggccccagcgcgcgcagacaggtcattgggtgagaggttcccgcgccgacttccatgtccaatggttgaacaatggtgcagccctggcgagcccagtaatcctgtaaggtcaggatcaagccctggaaggtcctggtatcaaacttttgcatattatttcgtgctggatacgtgtggatttaaaggaagggatcagtatacccgctggatggaagatatacagtacgaaacgggaaaaagcagggcttaacgcatggaaagatgcaaaaaatggccatctgcgtcaaaagaacagacaaactgctctttacggaaggtataaccgcgcatttcgtagcttccctggaactgttcgaaggcggtgacgtcgattttttgctcgccggtgttataacgttttgccgcctgatccttgcataacgcttccatattcaacgaacgcagaggatcaacctttacccgttgtgctttctgcacgggtggcggtgtagaacaacccactagcgccataagcaccataagcgccattgccggaaagaaagagttcatcatcattaaattaccgtctggtttgcaggtgagtcttattatttatatcggtatagtggctgatatcttacgaatttccttaagcctctataagctgtagtgataaaactcagattattccagtgcgccaaccgaatgatttatcggtcagactttttttaaccagatacagagacacagatgcagcccaaaatttactggattgataacctgcgagggatagcgtgtttaatggtggtgatgattcacaccactacctggtatgtgaccaatgctcatagtgttagccccgtcacatgggatatcgccaatgttctgaattctgcctctcgtgtcagcgtgccgctatttttcatgatttccggctatctcttttttggcgaacgcagcgcccagccgcgccatttcttgcgcatcggcttatgcctgctgttttatagcactgttgcgctgctctacattgcgctatttacctccatcaatgtggagttagcgctgaaaaacctgctgcaaaagccagtgttttaccatttatggtttttcttcgcgattgcagtgatttatctggtttcaccgctgattcaggtgaagaacgtcggcggaaaaatgttgctggtgctaatggtgatgattggtatcatcgctaacccaaatactgtgccgcagaaaatcgacggttttgaatggctgccaattaacttatatatcaatggcgatactttttactacatcctttatggcatgttgggccgcgctatagggatgatggacacacagcataaagcactgtcgtgggtgagcgccgcactgtttgcgacgggggtttttattatctctcgcgggacattatatgaattacagtggcgcggaaattttgccgatacctggtatctttactgtgggccgatggtttttatctgcgcaatcgcgttattgactctggttaaaaacacgctgtatatgcgtaccatttgcggacttggcttaatctcccgccattcgttaggtatatacgggttccatgcattgattatccatgcactgcgcacccgggggattgagcttaaaaactggccaatactcgatattatttggatcttttgcgcgacgttggcagcgagtttgttactttctatgctggtacaacgaatcgacagaaacagattagtgagttagtaaaagcccggttacattggactaaccgggcttatgtgaattattcgctgtattcttcctgggtaacctgtgtttcttttggtgggtttattccggcatcacgaatattcttctgcaccgctactgcaccaaacaagcttaagaagaaagccagcccataaaagcctttttcgctgagtaataacgttgcattccatagacctaccagcaacaacgcaacagagataataaagaccgtcaggcaagtcatataataaatggggtggtaggtatgccttcatacttgtcccgaacggtcttttgataagacgccgcggaaaacaaacctaataccagtacggcaaaataataccctttttcatttaactgcatctctgcattccatagtcctaacagataggtaacaataccgccaataagggctacccatgaaacaatactaaatgccggagaataggttgatattttgttgtccatcacagtattcctttcattcctgaatgtgtaagaactttatgttgctcatgccgagcgaaacaaacgcatttgaccaaacaagcagacaaaaaaggcgatgggatagatcaccatttcataagcattgataggtgcgtttaaaacaccgataaacaagagaccgatagtgattaacgctaccaactgacagacgtggataaaaaaatcatccagttgcccaagtttttctgcgcgaagatatgcatagttgccaaaagttgccgtcattaacacgccaagaaaataaccttttccacttaacaatgggcatgagatccatagcccaaccagataaaccagcgccccgacaacaaataatagttttgccacagtctttgaggttttcataacgatctccatatctaccagcgatacattacgagtaaccaacgaaagacaaaactgaaaaatgccattaacaaatgattttcagaataaattcatactaaatattaattaattactgagatatatagatgtgaattatcccccacccggtcaggcaggggataacgtttacgccattaatggcagaagttgctgatagaggcgacggaacgtttctcgtcgtggctgataagcggcataacgctgcgcatctggtagatgcgactgttctaacggtagttgcggcaacaactcaatgagcgatttctctggattcgccgcaatctgcgccagccttgctgcgcccagtgctggccccacatcgccacccgtgcggtaatccagttgctgaccgctgatgtccgccagcatttgacgccagtactcactacgcgccccgccaccaatcaacgtaacactttgcggtttaatgccgcaggcatgcacgacatccatgccatctgccagcgcataacccacgccttccagcactgctcgcgccagttcattggggccatgttgatgagtcaaaccaaagaaaacccctttcgcctggggattattgtgtggtgtacgctcgccggaaagataaggcagaaaccaaactggctcggcactttcatcagcctgttgagctgcagtgattaaagcagggacattgctcaggccggttaatttcgcggcccaatccagacacgaagccgcactcagcattacagacattaaatgccaacgttgcggtaacgcatggcaaaagctatgtacggcgctttctggcttgcttaagaacccttcgctgacagcaaaatagacccccgacgtccccagcgataacattgcctgattagcatcaaccattcccacaccaaccgcaccagctgcattgtcgccaccgcctgcgataactggcaccgccgccataccccacgctttcgcaacttcaggtaacaaagcaccagtaatttcgctgccttcgtataatgcgggcatctggtcacgagataagtggcaagcctgcagcatgagatcgctccagtcacgctttgcgacatccagccacatagtgccagctgcgtcagacatatcgctggcaaactcccccgtcatacgcagacgcaagtaatctttcggtaataataccttatcgatttgacggaatatctccggctcatgccgctgaacccatagcaatttaggcgcagtaaatccgggcatcatcaggttgccggtaatcacccgcgattgcggaactcgcgcttccagcaaagtgcactcttgcgcacagcgcccgtcgttccacaaaatggcagggcgtaacacccgttgctgagcatccagtaaggttgcaccgtgcatctgtccggcaatacctaatgctttaacgtcttgcagagaatgctgaacgcccagagctttcattgcgcgatcagttgcctgccaccactgttccgggtcttgttccgaccagagtggatgcgggcgcgaaacggtcagcttttccgtttgcgcagcaaccacctcaccctgctcgttgagcaaaataacttttacgcccgaggtgccaagatctatcccgatatacatatcgatcgttccttaaaaaaatgcccggtatcgctactgataaccgggccaacggactgcacagttagctgttatttgtcgaacagataatgatttaccagattttccagttgctcctggcgaccactctgatgcaccggagacaaattatgttcctgagcatatttggctaaatctgccagtgacatttggcctttcaggatttgctggcctaattcactattccagccggaataacgctgcgcgatgcgtttatccagctcgccatcttcaatcatgcgcgctgcaattttcagcgccaacgccatcgtatccatcgcgccgatatgaccgtaaaacagatcatatttatcagtactttgacgacgtactttggcatcgaagttcagaccaccggtggtgaaaccgcctgctttgagaatttcatacatcaccagcgcattctcttccacactgttcgggaactggtcggtgtcccagcccagttgcgcatcgccacggttggcgtcgacagaaccgaacaggccaagcgcaatggcggtggctatttcatgatggaaagagtgacctgccagcgtcgcgtggttagcttcaatgttcagtttaatctctttttccagaccaaactgtttcaggaagccatagaccgtcgcagcatcgtaatcatattgatgtttggtcggttcttgcggtttcggttcgataagcaacgtgccctggaaaccgattttatgtttatgctcaaccaccatctgcataaagcggcccagctgttcacgctcctggcgcaagtcggtatttaacagcgtttcgtaaccttcacgaccaccccacaggacatagttttcaccgcccaatttatgggttgcttccatcgctgtaacaacttgcgttgccgcccaactgaagacttcaggatctgggttcgtcgccgcacccgcgccatagcgagggtttgtaaagcagttagcagttccccacagcagcttcacgccgctctcttcttgcttgcctgccaggacatcaaccatttgcgcaaaattattgatgtactcttttaacgacgcgccctcaggggaaacatccacatcgtggaagcaataaaatggcacatgtaacttgtggaaaaactcaaatgcgacatctgctttacgcttcgccaacgccagtgcctcaccaggctgctgccacggacgattaaacgcccccacaccaaacatatctgccccgttccagcagaaggtgtgccagtagcaggcggcaaaacgcaagtgctcttccatacgcttgcccaacaccagttcgtcgggattgtagtgacggaatgctaacgggtttgaggattttgagccttcataacgaacgcgatcgagctggtcaaaataggcttgcatattgaactccataatcaggtaatgccgcgggtgatggatgatgtcgtaatattgggcactccctttcagttgctcaattatgttatttcacactgctattgagataattcacaagtgtgcgctcgctcgcaaaataaaatgggatgatgaaactgggtaattcctcgaagagaaaaatgcaataagtacaattgcgcaacaaaagtaagatctcggtcataaatcaagaaataaaccaaaaatcgtaatcgaaagataaaaatctgtaattgttttcccctgtttagttgctaaaaattggttacgtttatcgcggtgattgttacttattaaagctgtcctctaactacagaaggccctacaccatgaaaataaagaacattctactcaccctttgcacctcacttctgcttaccaacgttgcggcacacgccaaagaagtcaaaataggtatggcgattgatgatctccgtcttgaacgctggcaaaaagatcgagatatttttgtgaaaaaagcagaatctctcggcgcgaaagtatttgtacagtctgcaaatggcaatgaagaaacacaaatgtcgcagattgaaaacatgattaaccggggtgtcgatgttcttgtcattattccttataacggtcaggtattaagtaacgttgtaaaagaagccaaacaagaaggtattaaagtattagcttacgaccgtatgattaacgatgcggatatcgatttttatatttctttcgataacgaaaaagtcggtgaactgcaggcaaaagccctggtcgatattgttccgcaaggtaattacttcctgatgggcggctcgccggtagataacaacgccaagctgttccgcgccgggcaaatgaaagtattaaaaccttatgttgattccggaaaaattaaagtcgttggtgaccaatgggttgatggctggttaccggaaaacgcattgaaaattatggaaaacgcgctaaccgccaataataacaaaattgatgctgtagttgcctcaaacgatgccaccgcaggaggggcaattcaggcattaagcgcgcaaggtttatcagggaaagtagcaatttccggccaggatgcggatcttgcaggtattaaacgtattgctgccggtacgcaaactatgacggtgtataaacctattacattgttggcaaatactgccgcagaaattgccgttgagttgggcaatggtcaggagccaaaagcggataccacactgaataatggcctgaaagatgttccctcccgcctgctgacaccgatcgatgtgaataaaaacaacatcaaagatacggtagttaaagacggattccacaaagagagcgagctgtaagcgttacgccccggcgcggagcgggggcgtgatttctctccatgccgcgttaattaattggcttaggtggagtcgttatgccttatctacttgaaatgaaaaatattaccaaaaccttcggcagtgtgaaggcgattgataacgtcagcttgcggttgaatgctggcgaaatcgtctcactctgtggggaaaatgggtcaggtaaatcaacgctgatgaaagtgctgtgtggtatttatccccatggttcctacgaaggcgaaattatttttgcgggagaagagattcaggcgagtcacatccgcgataccgaacgcaaaggtatcgccattattcaccaggaattggcgctggtgaaagaactgaccgtgctggaaaatatcttcctgggtaacgaaataacccataatggcattatggattatgacctgatgacgctacgctgtcagaagctgctcgcacaggtcagtttatccatttcacctgatacccgcgttggcgatttaggacttgggcaacaacaactggttgaaattgccaaggcacttaataaacaggtgcgtttgttaattctcgatgagccgacagcctcattaactgagcaggaaacgtcggttttactggatattattcgcgatctacaacagcacggtatcgcctgtatttatatttcgcacaaactcaacgaagtcaaagcgatttccgatacgatttgcgttattcgcgacggtcaacacattggtacgcgtgatgctgctggaatgagtgaagacgatattatcaccatgatggtcgggcgagagttaaccgcgctttaccctaatgaaccacataccaccggagatgaaatattacgtattgaacatctgacggcatggcatccggttaatcgtcatattaaacgagttaatgatgtctcgttttccctgaaacgtggcgaaatactgggtatcgccggactcgttggtgccggacgtaccgagactattcagtgcctgtttggtgtgtggcccggacaatgagaagggaaaatttatattgatggcaaacaggtagatattcgtaactgtcagcaagccatcgcccaggggattgcgatggtacccgaagacagaaagcgcgacggcatcgttccggtaatggcagttggtaaaaatattaccctcgccgcactcaaaaaatttaccggtggcattagccagcttgatgacgcggcagagcaaaaatgtattctggaatcaatccagcaactcaaagttaaaacgtcgtcccccgaccttgctattggacgtttgagcggcggcaatcaacaaaaagcgatcctcgctcgctgtctattacttaacccgcgcattctcattcttgatgaacccaccaggggtatcgatattggcgcgaaatacgagatctacaaattaattaaccaactcgtccagcagggtattgccgttattgtcatctcttccgaattacctgaagtgctcggccttagcgatcgtgtactggtgatgcatgaagggaaactaaaagccaacctgataaatcataacctgactcaggagcaggtgatggaagccgcattgaggagcgaacatcatgtcgaaaagcaatccgtctgaagtgaaattagccgtaccgacatccggtggcctttccgggctgaaatcactgaatttgcaggtcttcgtgatgattgcagctatcatcgcaatcatgctgttctttacctggaccaccgatggtgcctacttaagcgcccgtaacgtctccaacctgttacgccaaaccgcgattaccggcatcctcgcggtaggaatggtgttcgtcataatttctgctgaaatcgacctttccgtcggctcaatgatggggctgttaggtggcgtcgcggcgatttgtgacgtctggctaggctggcctttgccacttaccatcattgtgacgttggttctgggactgcttctcggagcctggaacggatggtgggtcgcgtaccgcaaagtcccttcatttattgtcaccctcgcaggcatgttggcatttcgtggcatactcattggcatcaccaacggcacgactgtttcccccaccagcgccgcgatgtcacaaattgggcaaagctatctacctgccagcaccggcttcatcattggcgcgcttggcttaatggcttttgttggctggcaatggcgcggaagaatgcgccgtcaggctttgggtttgcagtctccggcctctaccgcagtagtcggtcgccaggctttaaccgctatcatcgtattaggcgcaatctggctgttgaatgattaccgtggtgttcccactcctgttctgctgctgacgttgctgttactcggcggaatgtttatggcaacgcggacggcatttggacgacgcatttatgccatcggcggcaatctggaagcggcacgtctctccgggattaacgttgaacgcaccaaacttgccgtgttcgctattaacggattaatggtagccatcgccggattaatcctcagttctcgactcggcgctggttcaccttctgcgggaaatatcgccgaactggacgcaattgcagcatgtgtgattggcggcaccagtctggcaggcggcgtcgggagcgtggctggagcagtaatgggggcattcatcatggcttcactggataacggcatgagtatgatggatgtaccgaccttctggcagtatatcgttaaaggtgcgattctgttgctggcagtatggatggactccgcaaccaaacgccgttcttgattttgataaaaattctctcaaagccggtaacgtattaccggttttgagtttttgcatgattcagcaggaaaagaaccatgtttactaaacgtcaccgcatcacattactgttcaatgccaataaagcctatgaccggcaggtagtagaaggcgtaggggaatatttacaggcgtcacaatcggaatgggatattttcattgaagaagatttccgcgcccgcattgataaaatcaaggactggttaggagatggcgtcattgccgacttcgacgacaaacaaatcgagcaagcgctggctgatgtcgacgtccccattgttggggttggtggctcgtatcaccttgccgaaagttacccacccgttcattacattgccaccgataactatgcgctggttgaaagcgcatttttgcatttaaaagagaaaggcgttaaccgctttgctttttatggtcttccggaatcaagcggtaaacgttgggccactgaacgcgaatatgcatttcgtcagcttgtcgccgaagaaaagtatcgcggagtggtttatcaggggttagaaaccgcgccagagaactggcaacacgcgcaaaatcggctggcagactggctacaaacgctgccaccgcaaaccgggattattgccgttactgacgcccgggcgcggcatattctgcaagtatgtgaacatctacacattcccgtaccggaaaaattatgcgtgattggcatcgataacgaagaactgacccgctatctttcgcgcgtcgctctctcttctgtcgctcagggcgcacggcaaatgggctatcaggcggcaaaactgttgcatcgattattagataaagaagaaatgccgctacagcggattttggtcccgccagtccgcgtgattgaacgacgttcaacggattaccgctcgctgaccgatcccgccgttattcaggccatgcattacattcgtaatcacgcctgtaaagggattaaagtggatcaggtactggatgcggtgggcatatcacgctccaatcttgagaagcgttttaaagaagaggtgggcgaaaccattcacgccatgattcatgccgaaaagctggagaaagcgcgcagcctgctgatttctactaccttgtcaattaacgagatatcgcaaatgtgcggttatccatcgctgcaatatttctactctgtttttaaaaaagcatatgacacaacgccaaaagagtatcgcgatgtaaatagcgaggtcatgttgtagcgatgatgagaattatcggcgtcgcatcaggtaactcagcacaaccacctgatacgagcaaaagccttatccgcctgacaagtcggataaggctcgaggaaatgcaattacatatgcgccgcgattaaccgttggttatcctggtacattgcgaacaggtagttgttataactcttccctttggtcgagtagcccttcagcttgtgaatcatcgctgtggcagtcacttcctgatccgctttacgcagttgtgcacgcgatttacggaacgaagagtaagccgggtgcgtattgaggttagtgacataggcgctcaccgattctttgacagaactaaactgtgagtaccctttcactttacccggcgcattggtacaacgtcctttcatgcatttcatgccgaacaggttgttgttgttgcgcgccagctttgacgttccccaaccgctttctgctgcagccatcgtcgccaccatactggtagggataatgtctacgcgttcaagcaaggtattccacgggatttttcgcgtattaccagaccacttcaccttgtagcgtttggcgatgtctttcagacgcgcacgctcagcaggtgaccattggccctgatactgttttgaaatcagccagttacgttccgcagtaatggccgcattttggctggtaatgtaaggcattacagtccggagaaacgcctttttccttggtgttccggaagggtattttcgcaaatcaggaagtgaactactctttgcactattgcgagaatactcttgtttactgcttacctgtttattactagctttagttaagtgggacttttgactcgctgttgttgtgtgcgtcttcgctaacacctcactcgaaaacaccagagtgagtaacataagaatcatcgccccatatcgtcgtatgggagtcaaaatcatcaggtctcctggtcggatttaatcattccaacaccttatattttttacaaatttgagagttgaatctcaaatcatatcaaaaatagctgtcaagagcaccccaaggaatagtccaaatctgaaactatgtcacgagttaacgattcagattggcgctaaatcgcagaaaatgtggggtttatcgcaaaattcagccgttttttgcgcgcgatcgctcacccttgcttctcatcctgtggacttaccgctcagggatgagttttgtctggcttatcgctggcaaactgtctgaaatcgcagcaataaggactcatccgccatgaaactcgccgcctgttttctgacactccttcctggcttcgccgttgccgccagctggacttctccgggattccctgcctttagcgaacaggggacgggaacatttgtcagccacgcgcagttgcccaaaggtacgcgtccactaatgctaaattttgaccaacagtgctggcagcctgcggatgcgataaaactcaatcagatgctttccctgcaaccttgtagcaacacgccgcctcaatggcgattgttcagggacggcgaatatacgctgcaactagacacccgctccggtacgccaacattgatgatttccatccagaacgccgtcgaaccggtagcaagcctggtccgtgaatgcccgaaatgggatggattaccgctcacactggatgtcagcgccacttttgcggagggagccgccgtccgggattattacagccagcaaattgcgatagtgaagaacggtcaaataacgttacaacccgctgccaccagcaacggtttactcctgctggaacgggcagaaactgacacatccgcccctttcgactggcataacgccacggtttactttgtgctgacagatcgtttcgaaaacggcgatcccaataatgaccagagttacggacgtcataaagacggtatggcggaaattggcacttttcacggcggcgatttacgcggcctgaccaacaaactggattatctccagcagttgggcgttaatgctttatggataagcgccccatttgagcaaattcacggctgggtcggcggcggtacaaaaggtgatttcccgcattatgcctatcatggttattacacacaggactggacgaatcttgatgccaatatgggcagtaaagccgatctacggacgctggttgatagcgcgcatcagcgcggtattcgtattctctttgatgtcgtgatgaaccacaccggctatgccacgctggcggatatgcaggagtatcagtttggcgcgttatatctttctggtgacgagctgaaaaaaacgctgggtgaacgctggagcgactggaaacctgctgccgggcaaacctggcatagctttaacgattacattaatttcagcgacaaaacaggctgggataaatggtggggaaaaaactggatcagaacggatatcggcgattacgacaatcctggattcgacgatctcactatgtcgctggcctttttgccggatatcaaaaccgaatcaactagcgcttctggtctgccagtgttctataaaaacaaaacggatacccacgctaaagacatcgacggctttacccctcgcgattacttaacccactggttaagtcagtgggtccgcgactatgggattgatggttttcgggtcgataccgccaaacatgttgagttgcccgcctggcagcaactgaaaaccgaagccagcgctgcacttcgcgaatggaaaaaagccaaccccgacaaagcattagatgacaaacctttctggatgaccggtgaagcctggggccacggcgtgatgcaaagtgactactattgctacggcttcgatgcgatgatcaatttcgattatcaggagcaggcggcgaaagcagtcgattgtctggcgcagatggatacgacctggcagcaaatggcggagaaattgcaggatttcaacgtgttgagctacctctcgtcgcatgatacccgcctgttccgtgaagggggcgacaaagcagcagagttattattattagcgccaggcgcggtacaaatcttttatggcgatgaatcctcgcgtccgttcggtcctaccggttctgatccgctgcaaggtacgcgttcggatatgaactggcaggatgttagcggtaaatctgccgccagcgtcgcgcactggcaaaaaatcagccagttccgcgcccgccatcccgcaattggcgcgggcaaacaaacgacactttcgctgaagcagggctacggctttgttcgtgagcatggcgacgataaagtgctggtcatctgggctgggcaacagtgacttttccggcttcccgttcgtcagtacctcgggaagccgccaaccaggataaaatgtcagccctaatcagcattgcaggataaagcaccgctcactcttcaacagagcgatttgcaccccagcaaatgtagcgttattgttaccttccttgctacagagttcgacagatatcccgctatgacattctccctttttggtgacaaatttacccgccactccggcattacgctgctgatggaagatctgaacgacggtttacgcacgcctggcgcgattatgctcggcggcggtaatccggcgcagatcccggaaatgcaggactacttccagacgctactgaccgacatgctggaaagtggcaaagcgactgatgcactgtgcaattatgacggtccacaggggaaaacggagctactcacactgcttgccggaatgctgcgcgagaagttgggctgggatatcgaaccacagaatattgcactaacaaacggcagccagagcgcgtttttctacttatttaatctgtttgccggacgccgtgccgatggtcgggtcaaaaaagtgctgttcccgctggcaccggaatacattggctacgctgacgccggactggaagaagatctgtttgtctctgcgcgtccgaatattgaactgctgccggaaggccagtttaaataccacgtcgattttgagcatctgcatattggcgaagaaaccgggatgatttgcgtctcccggccgacgaatccaacaggcaatgtgattactgacgaagagttgctgaagcttgacgcgctggcgaatcaacacggcattccgctggtgattgataacgcttatggcgtcccgttcccgggtatcatcttcagcgaagcgcgcccgctatggaatccgaatatcgtgctgtgcatgagtctttccaagctggggctacctggctcccgctgcggcattatcatcgccaatgaaaaaatcatcaccgccatcaccaatatgaacggcattatcagcctggcacctggcggtattggtccggcgatgatgtgtgaaatgattaagcgtaacgatctgctgcgcctgtctgaaacagtcatcaaaccgttttactaccagcgtgttcaggaaactatcgccatcattcgccgctatttaccggaagatcgctgcctgattcataaaccggaaggagccattttcctctggctatggtttaaggatttgcccattacgaccgagcagctctaccagcgcctgaaagcacgcggcgtgctgatggtgccggggcacaacttcttcccgggactggataaaccgtggccgcatacgcatcaatgtatgcgcatgaactacgtaccagagccggagaaaattgaggcgggtgtgaagattctggcggaagagatagaaagagcctgggctgaaagccactaaaaattgcctgatgcgctacgcttatcaggcctacatgatttctgcaatatattgaatttggtagaatttgtaggccggataaggcgttttagccgcatccggcataaacaaagcgcactatccctgcgttgagaaacgccggaaaaacgtttcaaacaggctgctgccgtagccgatgccgctgcactttctcgacatccatgcactgcaacgcctttgtcgggcaggcttcaacacaggccggccccgtcgcccgatgccagcacagatcgcacttaatcgccctcgcctttttgcgcgaagaaacgacctccatcgcaccaaacgggcaagccagcatacagcttttacagccaatgcaacgtgattgttcaacgaaaatatgcccatgttcgcggcttatcgcgtcaacagggcacacatttgcgcacggtgcatcttcacactgatgacaggctactgccgtggtgtaagtatgatctttaatgacacgaatacgggaaataaactcgtctggtgacaacgcagcgcaatcctgattctcctgatgcgacactgcgcaagccacttcacaggtacggcaaccgatacatttcgtcgcatccgcaataataaaccggttcatgatcactcctttgcactaaaacagcagagtgccagagagcgcgtccctactgctttgatccaacgaaggaaatgttaaagttttggcacttgtccaaagggttatgtaatcgcgccctggtcgtccctgacagtaaatcccagttcattagaaatagcctgcgcggtttcacgaagtggtttcaggagatttttctctcccacctgtttcagacgtgatgtcgaaagcgaaatcgacacggcgtacggcacccgcccatgaatatcaaacaccggaacagcaatacaggagacgccgagttcgttttcttctctgtccatcgccgctccactttcacgaatgtgcgccagttcgtcgaacatcgcgggcagctcggtaatggtattgcgggttaacggctggatctcatgctgatggctttcccagtatgacttcacgtagtccgggtgaccaaacgccatgtagatcttgcccattgcggaacagtagagcggcatatgctggcctatataggcacgggttcgcagcatcccggttgtgggttccagcttataaatcaaaatagcgtgatcgtcttcgcggctggagaagttaatagtttcaccagtggcgatgttcagagcctcaagatgcggagcggcgatatgaatgatattcagcgaagatagcgccttctgcccgacggcaataaatttggtggtcaggcgataactccctgcggcgggcgcggtggtcacatagccgcaggactgtaatccctgcaataagcgatggacggtactcttatttaaaccagccagctccgaaagatgcgccaacggacaaccgtttggatagttgctcaaaatctcaatcagcatcaacccacgaaacagactctggcttccggctgggcgctctttttcctgcgccatctcgttctctttttttcccatcacttctttccccattttgtcgcgtcctgatggtagcgcaaagtgtgccgtagttcacgatctcgacagataatttataaccacttgatttttaagttttttgaaattcatcaatcagattgctttgttaaaaagtgatcgatatatttgaaatcaagtttcgtatattgaaattttaagccaaaaaagcgatcaaaaaaacaaggaagcctgggatgaaagtgacatttgagcagttaaaagcagcctttaatcgggtcttaatttcacgcggcgttgacagcgaaacggctgacgcctgtgcagagatgttcgcccgcaccaccgaatcaggcgtttattctcacggcgttaatcgtttccctcgtttcattcaacaactggaaaacggcgatatcattcctgatgcccaacccaaacgtataaccagcctcggcgcaattgaacagtgggacgcccagcgttcgatcggtaacctgacagcgaaaaagatgatggatcgcgccattgaactggctgccgatcacggtattggtctggtggcactacgtaatgccaaccactggatgcgcggcggcagctacggctggcaggcggcggaaaaaggctatattggcatttgctggaccaactccatcgccgtaatgccaccgtggggcgcaaaagagtgtcgcatcggcaccaacccgctgatcgtcgccattccttccacgccgatcaccatggtcgatatgtcgatgtcgatgttctcttacggcatgttagaagttaatcgcctggctggtcgtcagctcccggtagatggtggctttgatgatgagggcaatttgaccaaagaacctggcgttatcgagaaaaatcgccgcattttgccgatgggctactggaaaggttcgggcatgtcgattgtgctggatatgatcgctaccctcctttctgacggcgcatcggttgccgaagtcaccgaggacaacagcgacgaatacggcatttcacaaatttttattgccattgaagtggacaagcttatcgacggtcccacccgcgatgccaaactgcaacgcattatggattacgttaccagtgccgagcgtgctgacgaaaaccaggctattcgtttacccggccacgaatttactaccctgctggcagaaaaccgccgtaacggtattaccgttgatgacagcgtgtgggcaaaaatccaggcgttataaggagataagccatgatttttggacatatcgcgcagcctaatccgtgccgtttgcccgccgccattgaaaaggcgctcgattttctgcgcaccaccgacttcaacgccctggaaccgggcgttgtcgaaatcgacggcaagaatatttatgcgcaaattatcgatttaaccacacgcgaggcggtagaaaaccgtccggaagtgcatcgtcggtatatcgatattcagtttctggcgtggggtgaagagaaaatcggcattgctattgatacgggaaataataaagtcagcgaatcactattagagcagcgcgatattattttttatcacgatagtgaacatgaatcatttatagaaatgattccgggcagctacgctattttcttcccgcaggatgttcatcgcccggcatgtaataaaaatgccactacggcaatacgcaagatcgtggttaaagtggccctcgctgctttataaaaaatgattactggagcacataatgaaaacgaataatgccggttatattatcggcgcgtatccctgtgcaccttcttttcaccaaagaagtgaagaggaagagaaggatttctggcgacaattatctgagactccagacattttggggctggaacaaccttgcctggaaaattttcaccctcttggcgatcaatggttactccgtcatacgccagagagctggaaatttgtcgtcaccgcagtgatggaaaccatgcgtcgccgcagcgaaaacagcgggtttggtctcgcctccagtgatgaagaacagcgccaggcctgcgtggcgtactatcgccacctgttcaataaaatcaactcattgcaggctaataaagtgctcgcactggagctccaggctgcaccgttagcaacgaatcctaatgttatgcaagcgacggacgcttttgcccgctcattgaaagaaatcgccagttgggactggccgtgcaagctggtgctggaacactgcgacgccatgacatcttcttccccccgaaaaggctttttgcctttagaaaatgtgctggaagttattaccgattatgacatcagcatctgtatcaactgggcgcgctctgccattgaagggcgcaatacaacgctgccgctgacccacacccaaatggcgaaacaagccggaaaactcggcgcgttaatgttctctggtacgacgctaaacggggcatacggcgaatggcaggatttacacgcaccgtttgcaccattctgcgcagaaagcctgatgaccacagatcatgttcgcgagttatttaatgtagcagaatcgtcaacattgcattttgctggcatcaagctactggaaataaatgcgacggctgatgtgcaccatcgcatcgaaatattacgcaacggcattcactctctgaatgaatctcgttaaacagaaccatttatatatcactttgaatatctaattagccgttttctgataattattacgaatattaacaacattagcgcataaaaaatattgcataaccagaaggactcgttatgaaacggatactcgaaggcattcttgcgatcatcatcgcaatactgtcttgtattatttttattaatatcattcttcgatatggattccacacaagtatattatcgattgatgaattatcccgacttttatttgtctggttaacctttattggcgcaatcgttgcttatatggacaacagccatgtgcaggttacttttttagtcgaaaaactctcaccggctaatcaacaacgtgtttcgctgctaacccatacgctcattttattgctgtgtctggggctggcctggggcgctatagaaaaaacagcgcaagactggagcaacttatcgcccattcttggcgtccccattggcttaatgtacgccgccgctatccccaccagtctgattatcgcattgctggaattgcgtcacttataccggcagttcacaaatacccccagccgaaaccaacaaggagcctgacgatgacaatccttatatttattgtcagtttgttaggggctatcgcaattggcgttcccatcgcctgggcattattactgtgcggcatttcattgatgttctggatggatatctttgatgtgcaaattctggcacaaacgttggtaaatggcgcagacagcttctccctgttagccatccccttctttgtactggcgggtgagatcatgaacgcgggcggcctgtcgcaacgtatcgtcgacttgccaatgaaactggtaggccacaggccaggcggtctgggttacgtgggcgtgctggcagcgatgatcatggcaagcctgtccggttctgcggttgctgataccgcagctgtcgcggcgctgctggtgccgatgatgcgccaggccaactatccggtaaaccgcgccgccgggcttatcggttccggggggattattgcggccattatcccgccttccataccactcattatcttcggcgtctccagcggactctccatcagcaaactgtttatggcgggcattgcgccaggcatcatgatgggcgtcacgctgatggttacctggtggtggcaggcaaaacgactgaatttaccttgtcagccgaaagcctcactgcgagaagtctggcaatccttagtttccggtatttgggcgctctttttaccgataattattattggcggtttccgttcggggttatttacaccgaccgaagcaggcgcggttgccgccttctacgctctgttcgtctcggtggtggtctatcgcgagatgaccttctccacgctttatcatgtgctgattaacgcggcaaaaaccacatccgtggtgatgttcctggtggcctctgctgcggtatctgcatggcttattacgatcgccgaattacccatgatggtatcggagctattacaaccgttggttgattcgcctcgcttattattcatcgtcattatgctcgctattatggtgatcagtacggtcatggacttaacgcctaccgtattaattcttacaccagtattaatgccattagtgaaagaagcgggaatagatccggtctatttcggcatcatgtttattatcaactgttcaatatcactgattacgcctccagtcggtaatgttcttaacgtggtatgcggcgtggcgaaacttaaatttgacgatgcggtaaaaggcgttgcgccttacgtcatggttttattcatgttgttagcattatttatttttataccggagctcattaccgctcctcttaaatggatgagttaaaaggaaatcataatgaaattacgttctgtaacctacgctttattaattgccggagtggcgacgttcagcacatcttctctggcggcacaatcattacgtttcggttatgaaacctcacaaaccgattcacaacatattgcggcgaaaaaatttaatgaattactgcaggaaaaaaccaaaggcgaactgaaattaaaactgttcccggatagcacccttggtaatgcgcaggcgatgatcagcggcgtgcgtggcggcactattgatatggagatgtctggctctaacaactttacgggactctcgcccgtcatcaacctgctcgatgtcccgttcctgttccgcgataccgctcacgcgcataaaacgctcgacggcaaagtcggtgatgacctgaaagtctcccttgaaggtaaggggctgaaagtactggcctactgggaaaacggctggcgcgatgtcaccaactcgcgtgcaccggtcaaaacgcctgccgacctgaaagggttgaaaatccgcaccaacaacagcccgatgaatatcgctgcatttaaagtttttggcgctaacccgatcccgatgccgtttgccgaagtctataccgggctggaaacccgcactatcgacgctcaggaacacccgatcaacgtcgtctggtcagcaaaattttatgaagtgcagaagtacctttctctgacccatcacgcctattcgccgcttctggtggtgatcaacaaagcgaagtttgatggcttaaccccggagttccagcaagcactgatctcatctgcacaggaagcgggtagctatcagcgcaaactggtcgccgaagatcagcaaaaaatcatcgacggtatgaaagaagcgggcgtggaagtcatcaccgatctcgaccgcaaagcctttagcgatgcgctgggtacccaggtccgtgacatgtttgttaaagatgttccgcagggtgctgatctgctgaaagccgtggatgaggtgcaataaaccatgacgcaatactggctggggttagattgtggcggtagctggctgaaagccgggctgtatgaccgagaaggccgggaggcgggcgtgcagcgcctgccgctgtgcgcattaagtccacagccaggctgggcagagcgcgacatggcagaactgtggcaatgttgcactgctgtcattcgcgccctgcttacccattccggcgtcagcggggaacaaattgtcggtatcggcatctccgcgcagggaaagggcttatttctacttgataaaaacgacaaaccgctcggtaacgccattttgtcctcggatcgccgggcgatggaaatcgttcgtcgctggcaggaagatggcatcccggaaaaactctatccgctgacccgacaaaccttatggaccgggcatccggtgtcgctgttacgctggctgaaagagcacgaaccagaacgctacgcgcaaattggctgcgtgatgatgacgcacgactacctgcgctggtgtttaaccggcgtcaaaggttgcgaagagagcaatatttctgagtccaatctctacaacatgagtcgcggggaatatgacccgtgccttaccgactggctggggattgctgaaatcaatcacgccctgccgcctgttgtcggatctgccgaaatctgcggggaaatcaccgctcagacagccgtactgaccggtctgaaagcgggtacccccgttgtcggcggcctgtttgatgtggtttccaccgcactctgcgccgggctcgaagacgaattcaccctcaatgcggtgatggggacctgggcggtgaccagcggcataacccacggtttacgtgatggtgaagcgcatccgtatgtctatggtcgctacgttaacgatggtcaatttatcgttcacgaagccagccccacctcttccggcaatctcgaatggtttaccgcacagtggggagaaatctcatttgctgagattaatcaggccgtagccagtttgccgaaagccggtggcgatctctttttcctgccgttcctgtacggcagcaacgccggactcgaaatgaccagcggtttctacgggatgcaggccattcacacccgtgcacacctcttacaggctatctatgaaggggtggtgttcagccatatgacccatctcaaccggatgcgcgaacgttttactgatgtgcacaccctgcgcgtcactggcggcccggcgcactccgatgtctggatgcaaatgctggcggacgtcagcggtctgcgtatcgagctgccgcaggtggaagaaaccggctgctttggtgcggcacttgccgcccgcgtcggtaccggggtttatcgcgatttcagcgaagcccaacgtgacttacagcacccggtacgcaccctgctgccgaatatggccgcgcatcagctttaccaacaaaaataccaacgctatcaacatctcattgccgcacttcagggttatcacacccgcatcaaggagcacacattatgagtcgaccacttctgcaactggccctcgaccactcatcacttgaagccgcgcagcgcgacgtgacgcggttaaaagacagcgtcgatattgtcgaagcaggcaccattctctgtttaaacgaagggcttggcgccgtgaaagccttgcgcgaacagtgccctgacaaaatcatcgttgccgactggaaggtcgccgacgcgggtgaaacgctcgcgcaacaggcatttggcgcaggcgctaactggatgaccatcatctgcgccgcgccgctcgccacggtggaaaaaggccacgcgatggcacagaactgcggcggtgaaattcagatcgagctattcggcaactggacgctggacgatgcccgtgactggcatcgtattggtgtacgacaggcgatttatcatcgtggtcgtgacgcgcaggccagcgggcaacagtggggcgaggccgatctggcacgcatgaaagcgctttccgatatcggccttgagctttccattactggcgggattacccctgctgacctgccgctgtttaaagagatccgcgtgaaagcgtttattgccggacgggcgctggcaggcgcagcaaatccggcgcaagtggctggcgatttccatgcgcaaatcgactccatctggggaggcaagcgtgcgtaatcatccgttaggcatttatgaaaaagcgctggcgaaagatctctcctggccggagcggctggtactggcaaaaagctgtggttttgattttgtcgaaatgtcggtggatgaaaccgacgaacggttgtcacgtcttgactggagcgccgcacaacgtgcttcgctggtcactgcgatgatcgaaacgggtgttgctattccgtcaatgtgcctgtccgcacatcgtcgttttccttttggtagccgggacgacgccgtgcgccagcgggcgcgggagattatgagtaaagcgattcgcctggcgcgcgatctcggcattcgtactattcaactggcaggttacgacgtctattacgaggatcatgacgaaggcacccagcaacggtttgctgaagggctggcgtgggcggttgaacaggcagcggcatcacaagtcatgctggcggtggagattatggacaccgcgtttatgaactctatcagcaaatggaaaaagtgggacgaaatgcttgcgtcaccgtggttcaccgtttacccggacgtaggcaatctcagcgcctggggcaatgatgttcccgccgaactgaaactgggcatcgaccgtatcgccgccatccacctgaaagacactcaacccgttaccgaacatagccccggacagttccgcgatgtgccgtttggcgaaggctgtgtcgattttgttggcatcttcaaaacgctgcatgagctgaactatcgcggatcatttctgattgaaatgtggaccgaaaaagccaaagaaccggtgctggagattattcaggcgcggcgctggattgaagcgcgtatgcaggaggccggatttatatgttagagcaactgaaagccgacatgctggcggcaaacctggcgcttcccgttcatcatctggtgacgttcacctggggcaatgtcagcgcgatagacgaaacgcggcaatggatggtgattaagccttccggcgttgagtatgaggtaatgaccgccgacgatatggtggtggttgagatagccagcggcaaggtggtggaaggcagcaaaaagccctcttccgacacgccaacgcatctggcgctttaccgtcgctttgcggagattggcggcatagtgcatacccactcgcgccacgccaccatctggtcgcaggccggacttgatctccccgcctggggcactactcacgccgattatttttacggagctatcccctgcacgcgcctgatgaccgcagaagagatcaacgacgagtatgaataccagaccggcgaagtgatcattaaaaccttcgaagagcgtgggttgaacccggcaaaaatcccggcggtactggtgcattctcacggcccgttcgcctggggaaaaaatgccgccgatgcggtgcataacgccgtggtactggaagagtgcgcctatatgggtctgttctcgcgccagcttgcgccacagctccctgcgatgcaaaacgaactgctggataagcactacctgcgtaagcatggggccaatgcctattacgggcagtagccatacctgatagtgcccggcaatacacgccgggcagcctttcacatcagaacagccccaacggtttatccgagtagctcaccagcaggcacttggtttgctggtaatgctcaagcatcattttgtgggtttcacggccaatgcctgattgtttgtagccgccaaacgccgcatgtgccgggtaagcgtgataacagttggtccacacgcgccctgcctgaatgccgcgccccatcttataggccagattaccgttgcggctccagacgcccgcgcccagaccatattgcgtatcgttcgccagctccagcgcttcttccatcgttttgaaggtggttaccgccagcaccgggccaaaaatctcctcctggaacacgcgcatattgttctgaccaaacagaatcgtcggttcgaggtagtagccgtctttcagttcgccttccagcagcttgcgtcgaccgccggtgagcacatcagcgccctcttttttaccgatatcaatgtagttgaggatggtttccagttgcccgtgagaaacctgcgcgcccatttgcgtcacgctgtcgagcgggttaccgctgcgaatgctttcgacacggcggatggcgcgttccataaagcgttcgtagatagactcctgcactaaagcacggcttggacaggtgcaaacttcgccctggttaaaggcaaacagtgcaaagccttccagcgctttatcgaaaaaggcatcttcttcatccatcacatcagcaaagaagatatttggcgatttgccgcccagctccagcgtcaccggaataatgttttgcgtggcgtattgcataatttgttgacccacttccgttgagccggtaaacgccactttggcgatgcgtttcgaggtcgccagatattcgccaatttccccacctgcgccgttgaccacgttcaccacgcccggcggcagtaaatccccgacgatttccattagcagcagtacagaaagcggagtaagacgtgcgggtttcagcaccacacagttgccagccgccagcgcgggcgccattttccagctcgccatcagcagcgggaagttccacgggataatctgccccaccacgcctaacggctcatggaaatgataggccacggtttcgctatcaatttcactgatcccaccttcctgcgcccgaatacacgaggcaaaatagcgaaaatgatcaatcgccagcggcacgtcggcagcactggtttcgcgaatgggtttaccgttatcccaggtttcagcggtcgctaacagttcgaggttctgctccatccgatcggcaatcttaaacagaatcgccgcgcgatcctgcaccgaggtgtgcgcccatttatctttcactttgtgcgcagcatccagcgccagatcgatgtctcgtttgcccgaagacgccacttcgcacagtagctgcccggtcaccggcgtcaggttctggtaatactcgccatcggcaggcgctacccattcgccaccgataaagttgtcgtagcgggcttttaatttgagggggaaaccatactcgccgggcttaatctgtgctgaagggggattattggtcatgatcgtctccttgctgtgtgaggtataacaagggtagacgtgactggcgaaatcttcgccagtcggtaacagctttacgacggctatcacgaatttacgggcaaaagctacagcgggtagtgtgcgacgtacactgcttgctggttattaattcttttctcttgcgcgaatccttctttaacaattgtccgtaaatcggtccgcgccgtattatccgagacgctcagactcacactaatttcagcaactgtgtactctttccccggattggcgagcatcacattcaggagcgttacctggcgcggattcaggcgtttaagcacaccagagctaaacagcacactatcgagttttgcgcttcgttgtgtaatttcatcgatatgctgctgccagttttgcagagcacgtttaatgacacccgcctgatattcaaggaaataagtcagatccataccatctgattcagtgtactggtagctggcggcatattttactggcgctgcatgaagcaaacggctgatggaaatatatttaaaaacatcgtagcccgatttcagcatataccagtaaaacagcgcccgactggtgcgcccgttgccatcccgaaacggatgttcatgggccagcataaaatgcagaatgcaggcacggaccaacggatgaatatacccttcatggctgtttaaccactggcaaactttttccagccgttccggtaacaatgccgcagcgggcggttgatgcactatattgccatcatagtcggcgatcacaacatcatctgtttcacgaaattctcccggacgatatttcgcgtcattgattccacccataccaatggcatgtaactggcgaataagcgcaggtgtcagcggttctgcgagtaagtgcggaatttccgccatcagccgggcatttcccgcaatcatatgctcgtcttcagtgcgtggcgaccgccctgtttccagcatttttctcgccaccagcgttgtagtattcgcaccttccagctgggagctggtgatcggctcttccaggcgtaactggcttaactcggctccggccccgcgtaaccgttcagtctgatctttcagcgccagcgcggtagcacgtttgtcgacaagctcgcacgcttctgcaatcaccggggtaatgttgaatccggcctgttcacccgcttcattgcaataattaattcgttggatcgccgcgttgcgcgccagacgggtaagcgtccacgccacatcgacgttttctccttttttgatgcggtactgcaactcatcaaaaggcagataacgtcctttttcatcggtaacccggttaaagcgcaggtgggccaggagttcctcacccgataagtgtgataaaggaataagtccgggaggtgatttgatagccatgtgcttatctcaaaaaagcgcaatattgagatagtgtatagcaggaaagagaaactatctcaaaaaaagcaagttttgagatagttgaaaaagcggctgacaactcgccagccgttgtgggaatgatgattacatcgctgcgcgataaatcgccacaatttcttcgtgagttgcctggatcgggttagtaaagccgcaggcatctttcagggcattagtcgccagaaccgcgaaatcttcttctttcacgttcaggtcgcgtaggcctgccgggatatccactttcttcgccagttcacggatggcgttaatgcaggcttcagcaccttccgcgtcgtttttacctgtcacgttcacgcccattgcagcggcacaatcacgcagacgtgcagcggcgactttgctgttgaatacctgaacatgcggcagcaaaacggcgttacatacaccgtgtggcaggttgtagaaaccgcccagctggtgcgccatcgcatgaacataacccagagaagcattattgaacgccataccggcgaggaactgggcataagccattgcttcacgcgctttagcattgctgccatcttcaacggctaacggcaggttttcggcaatcatggtcacggctttcagtgcacaagcgtcagtgatcggcgtggcggcaatagaaacatacgcttcgatagcgtgcgttaaggcatccatacccgttgcagcggtcagtgacttcggcataccgatcatcagagaggagtcattgacagaaagcagcggagttacatgtttatccacaatcgccattttgatgtgacgcgcttcgtcagtgatgatgcagaaacgggtcatttcagaggccgtacccgccgtggtgttgatggcgatcatcggcagctgcggttttgcagagcggtcaacgccttcataatcgcggatgtcaccgccgttggctgcaaccagcgcaataccttttgcgcagtcgtgtggagaaccaccgcctaaggaaatcacgctatcgcaattattttctttaagtaatttcaaacctgcggcgacgttttccgtggtggggttaggttgggtgccatcataaataacgctaaaaatattgcgttcttccagtgctttttgcacatcacccgccatacccaatttcgttaacatattgtcggtgacaattaaggtacgggtaaatccataatctgccatcatattcattgcatcattcaatgaatcagcaccaataacattcacggaaggaataaaaaaggttgaagctgccataacacactcctgaaagtgtaaaaaagggcgggcagcttactgaggattttcatttgaaaatatgatcaacattaccgtttattaaaatatttttaataaaaagcacgttacattcatcaaataacgtgccttcttaacattaataggaaattttgtatcaattcatatttattatgaattaatcatttccttatttttccggaaataataatgcgtcgcgcaataaatgatcatttccccgacgacgcgtaaaaccaatgcggtcaaaatattccagaatttgaattgccagttttcgaccaacacctaaacgatcgcggaaatccgccgcgcaggttgaaccacattcctgatcgagatcgcggatcatattggcaaattcgacaatccgatcgttacggtaataacgatctttaacgatcgccgtaattatcccctgctgggccgcctggcgtagcgtcaggcgcattgcttgctcgtcggttcccgtctcttttgccaggtcacgcacccaccatggctcgtcaccaaacagcggctctgctttttgccagatggcctgctgctctgcactgaagcccgctttatgatccggcagatgcagccagccgtgatggctgtggatgtcgccgctttcgcgcatcttttcaatcagcaacagtaccagcgcttcatcttccattggcaacgccatacgtcgcaaacgttcgcgcccaggaccaggttcatcgcgatgttgctcatgataagtcgctaatgtatcgagaattttccgctgccagcgggcggcaactggcgcattcaacaagctgtaaccagcctgaatatagccaggctgttgcagcagttcgcgcatcccttcgccgttgagctgccgtgcccaggcgaaatccgcaaggttaaccgcgccgcgttccagatgaacagataacgcatcggcatcgctctgcgcccgtgcaagagacgccagccattgcagatattccggcttacgcttaccgcgacgcggcgggttaagcatcaccacacgcgcccccgccagcgtgttgcgggccgagatatcgcgcagcactaagcgatcgttatccgccagccacagcggcgtgtcgaacaccagctcggcaaggttatcttccagcagcgaaacgcgtcccgtaacgtggctggcggcgtggtgaatatgcagcggctgccactgggtcagcggtgtatgggtttgaagctcgacaatcacccgtgtgaacggctccggcggcacatcggcaagcagccagtcgccacggttaatctgctctttttccgcatcacccgcgatgttaagcgcgatacgctgcccggcatgggcagtttctgttggctgattttgcgcatgcagcgcacgcacgcgcatcggtttatttacaccagtcagccagagtgaatcgcctactttcacttccccgcttaacgccgtaccggtgacgaccagcccggcaccttttacagtaaatgcgcggtcgatcgcgaggcggaaactatgttggctggcgtgttcacgttctggtaactgaagcagatgctcgcgcagggcatcaattccccgaccttcggttgctgcggtgataaacagttttgcctcagcaaaaccgtattcccgcagcatctcctttacctggcgttcaacctcatcaacacgcgcttcgtccacgcgatcggctttggtcagcgccactgtcagcatcgggttaccggtcagctgcaaaatcgccagatgctcacgggtctgtgccatcacaccgtcatcgcacgccaccaccaacagcgcgtgatcgataccaccaacgcccgccagcatgttggaaagaaacttttcatgaccgggtacgtcgataaaaccaggcacgcgaccatcaggctgcggccagtaggcatagccgagatcgatggtcatgccgcgctttttttcttccggcagacggtcggcatttacgcccgtaatcgcctgcaacaaggttgttttgccgtggtcaacgtgtccggcagtcgcaataatcatttcaacaacatctccaaaaaccgttgctcatcttcaaggcagcgtaaatccagccacaatcgtccgtcataaatacgaccaatcaccggcactggcaattcacgccagcgggcggctaatgactcaaggtggctaccgcgtccatcatggggggtaaacgttaatgccgcgctcggcaggcgatcaaccggcagcgaaccactgccgatctgcgaaagacatggcataacctgtaccgcaaactccgcgccgtaatgtgcggcaaggggagcctgtaaacgttgtgcctggatttgaatgacctctgcgctgcgggtaagcaggcgcagggtcggtaatttttcactcagagcttcagggtgtaaataaagacgcaacgtggcttccagcgccgcgagggtcattttatccgcgcgtaatgcacgcttcagcgggtggctttgcaggcgggcgatcatctcttttttaccaacaataattcctgcctgcggcccgcctaacagcttgtcgccggagaagctcaccagactgacgcccgccgcaatcaactcctgcggcattggctctttcggcaaaccgtactggctaagatcgaccagcgagccactgcctaaatcagtcaccactggaacatccagttctttgccgagcgccaccagttccgcttcatctatcgctttggtgaacccctgaatgctgtagttactggtatgtactttcatcaacagtgcggtattttcattcaccgcctgacgataatcattcgcgtgcgtgcggttggtggtccctacttcgtgtagggtgcatcctgcctgacgcataacatcgggaatacgaaacgcgccgccaatctccaccagttcgccgcgagaaaccaccacctctttcccgctggcagtggccgccaacatcaataacaccgccgccgcattgttattaacgatacaggcatcttccgcccccgtaatacggcacagcagctgcgccagcgcccgatcgcgatgtccgcgtccggcgtcgtccagatcgtactcgagggtcactggcgaacgcatagccttcataacggcttccaccgcggcttccgcctgtaaagctcgcccaaggttggtatgcagcacggttcccgtcaggttgattaccggacgcagcgcgctttgcgcctctttcgtcaaccgggcatcgacttcttgcgcccagttttcacaccacgcgggcagcgtctggctgtctcgaatcacttctcgcgcttcgtcaagcatctgacgcagcaattccaccacgcgggtgtgaccataagtatcacgcaaagaaaggaaggagctatcgcgcaataagcgatcaatagccggaagttgactatagagggaacgcgtttcggttgtcataggaaacctggctgatcaaggccctctcacacggagaagggcgtttaacataaccacggattgtaacgtgagatgggtcaggaggacatatcacgcatcaagcctttggcggttcggtgcgagcaaaactttcgcggctaaacaggttttcgaccagtttgactaagtgtgggcggtcgacacaccagcctggcgcaacgcggcggaaattgagatatccgacggcacaggcaatggcaatagtcgccagattgaccgtatcggttttgagcgtgccatcgaccagatatccttccagcacatccagactgcggttgattttctcacgctgacgtaacaattcatcttcagactgctgcgccgccggacgcgcctgttcacgcaccgataccagcccggcatccataatgccatccgccagtgcctcaattttgcgcacccgcagcgactccagcggatcgcgcggcaacatcgccggagcaacattcattaattcaatatattcagcgatgatcggtgaatcaaaccagcattcgccctcttcggtcaccagtaccggtacttttcctaacgggttaaattgcgccacgccgttatccgcgttatagggcagttcattaataaattcgaacgttatgcccttttctaacaacagaatagaaagtttgcgtacaaacgggctggtgtagctaccgacgagtttcatgccgagtcctttgtgcgaggaaaaatatcagtatggctcaggctcgcgcaaaacacaggtgatacaagtctcaatgatccaaataaagataatgcatccaactggtcattcttagcagcactttccgcatcaccgaaacatggctgaaatggtcggagtaaactgccacctgggcgtagatgccgtcgggtaaggcatcgatatcagcgttagggtccagttcaatggttcccagcacaccgtccgtgccgggcacgaccgttaatgattgcaataccccctgcgcctgataagaaccgcctggcacgacaggtaaaatactggtcagtttgccgtgaaacacctgcccaggtagcgcgttaaacaccacttccgcatcatcgccgggtttcagacgtaacagcgagttctgccgaaattgggcgacaatttgccgtttttgctcggggatgaaaaccatcaccggacgtagcggcaaggcagctgcgtatgtacctgggcggatcagtacctgagtgacgtagccattgctcggtgcgcgaatgacagtctgctcaaggttatattttgcttcagtaagttgcgctcttaagctcacaatctgcgactgctcgccgttaaccatactgtcgagctggctctggatctgcgcctgctccgccaccgagcctttcaccagcgcgtcctgcgcgaggaagttttgccgcgcatcgtcgatgtcacgttccgagaacggattcactgccgcctggctgcctttcaggtaacgttgataatttttaaacagacggtcgcgctccgctgaaacctgggtggtgttggcctgcgcttcagtgagctgcgcgcgcagcgtctttatattatgcgttgccgtcatcaggtcagcctgaagtctgtcaactcgcgcctggtaacgaaccgggtcgagcttaaaaagcacctcgcccttctgaataagctgattatttttgtcggtgacttcagtaacaattcccgtcacctgtggcgtgatggggatcgctatcactgccttttgcgcggtaaaagtgtaagggtggttgtagttcatcaacaaaatcaaaccactcaccagaaacacgcctcccagcgccgccgtcgccagcgtccactgattcaccggaatgcggaagattttaaagaccgcccacgccagcgccacgtaagttaaaacaatcaatagatccattattagatctccgggaacgtggaatagtcagtctttttctcggcggcgagttggtgctccagccgggaaatccggtcagaaagtgcggcgatttccgcgtcagtcgttttctcttgcggcgtaacatgcgactgcatgccccagccgcgctccggttgatagagcgtcgcccagatccacaggaacggccagataacatgcagagtaaacaggctcacccagcccgccgtatgaatagcgtcggcatggggatggttgcgctttttggcaatcagataagggatgtcatgtatcgcgatgattccataaaaaatcaccagaaagacgaagatcagcactcccaacgcgaaatagtttagaaacatatctgcctcggattcacgtttatcagtgttgttttttggctggcagccagaagggagtcaggctgatattttgacaataatccgggttcgcgattctcgccataacaccaaagaataattttaagaggtgatgagttgcttagttacataacgatttcatgacgaaggcataacatgctgtagatcacatcaggtgaacgccgtaagaaaatatcttgtgatttagatcacaaagattcaacaaaccatcaaaacaaaaatgtgacatcgctcacatttaaatgccatttttagcgaaaatcgccgccttgttgcttttttacacaagcattttgtgatgggcgtcacgtcaattacctctctaccccctacatttatgtgactgatatcacacaaaaggccgccgactggacagttaaccgattcagtgccagatttcgcagtatctacaaggtccggctacctctgccgccacattaacaaaaaacctcgggcttccagcctgcgcgacagcaaacataagaaggggtgtttttatgtcatccgatattaagatcaaagtgcaaagctttggtcgtttcctcagcaacatggtgatgccaaatatcggcgcgtttatcgcgtggggtatcatcaccgcgttatttattccaacagggtggttaccgaacgaaacgctggcgaagctggtcgggccgatgatcacttatctcctgccgctgctgatcggttataccggtggtaagctggtaggcggcgaacgtggcggcgtagtcggtgccatcaccaccatgggcgttatcgtcggcgcagatatgccgatgttcctcggttctatgattgcaggtccgctgggcggctggtgcattaagcacttcgaccgctgggtagacggtaagatcaaatccggttttgaaatgctggtgaataacttctccgcaggcatcatcgggatgatcctcgctattctggcatttctcggcattggcccggttgttgaagccctgtctaaaatgctggcggcgggcgttaacttcatggttgtccatgacatgctgccgctggcgtctatctttgttgaaccggcgaagatcctgttcctcaacaacgctattaaccacggtatcttctcgccgctgggtattcagcagtcccatgaactgggtaaatccatcttcttcctgattgaagctaacccaggtccaggtatgggcgtgctgctggcgtacatgttctttggtcgtggtagcgctaaacagtctgcgggcggtgcggcaatcatccacttcctggggggtatccacgaaatctacttcccgtatgtgctgatgaatccgcgtctgattctggccgttatcctcggcggtatgactggcgtgttcacgctgactatcctgggcggtgggctggtttctccggcatctccgggttctatccttgctgtactggcgatgacgccaaaaggtgcttacttcgctaacatcgcgggtgtgtgtgcggcgatggcagtctccttcgttgtctctgccattctgctgaaaaccagcaaagtgaaagaagaagatgatattgaagctgctgcacgtcgcgttcaggaaatgaaagctgagtctaaaggcgcgtctccactgtctgcgggcgatgtgactaacgacctgagccacgtacgtaaaatcatcgttgcctgtgatgccggtatgggttccagtgcgatgggtgcaggcgtgctgcgtaagaaaattcaggatgcaggtctgtcgcagatttcggtcactaacagcgcgatcaacaacctgccgccagatgtggacctggtcatcactcaccgtgacctgaccgaacgcgctatgcgccaggttccgcaggcacagcatatttcgctgaccaacttcctcgacagcggcctgtacaccagcctgaccgaacgtctggttgctgcccagcgccatactgaaaacgaagtgaaagtgaaagacagtctgaaagacagctttgacgattccagtgctaatctgttcaaactgggcgcggagaacatcttcctcggtcgcaaagcggccaccaaagaagaagcgattcgttttgctggcgagcagctggtgaaaggcggttacgttgagccggaatacgttcaggcgatgctggatcgtgaaaaactgaccccgacttatctgggtgagtctatcgcggtgccacacggtacggttgaagcaaaagatcgcgtgctgaaaacgggtgtggtgttctgccagtatccggaaggcgtgcgcttcggtgaagaagaagatgacattgcccgtctggtgattggtattgctgcccgtaacaacgagcacattcaggttatcaccagcctgaccaatgcactggatgatgagtccgtcatcgagcgtctggcacacaccaccagcgtggatgaagtgctggaattgctagcaggtcgtaagtaatccattcccaccctctccgcatgaagaaggtggggctaattgcctgatgcgcttcgcttatcaggcctacaacataaagcacaattagttttgtcggtcggataaggtgtttacgccgcatccggcagtcggtgcacaatgcctgatgcgacgctgacgcgtcttatcaggcctacaggtcagtgccaaacacgtaggccagataaggcgtttacgccgcatccggcaaaaagcccctctcctcacggagagggtttgggtgagggaaaagcctcaccccagccctctcgggtaaaaacattgatgaaggttaatactatgaaagcattacattttggcgcaggtaatatcggtcgtggctttatcggtaaactgctggcggacgcgggtatccaactgacgtttgccgatgtaaatcaggtggtacttgatgccctgaatgcccgtcatagctatcaggttcatgtggttggtgaaaccgagcaggtagataccgtttccggcgtcaatgccgtcagcagcattggcgatgatgtcgttgatctgattgctcaggtcgatttagtcactaccgccgttggccctgtcgtgctggaacgtattgctccggccatcgccaaagggctggtgaaacgtaaagaacaaggtaatgaatccccactgaacatcatcgcctgtgaaaacatggtccgcggcaccacgcagctgaaaggccatgtgatgaacgccctgccggaagatgccaaagcgtgggtagaagaacacgttggctttgttgattccgccgttgaccgcatcgtaccgccttcggcttcggcaactaacgatccgctggaagtgacggtagaaaccttcagcgaatggattgtcgataaaacgcagttcaaaggcgcactgccaaacatccctggcatggaattaaccgacaatctgatggcatttgtcgaacgtaaactcttcaccctgaatacaggtcatgctataaccgcgtacctcggaaaactggccggtcatcagaccattcgtgacgcaattctcgacgagaaaatccgcgcggtggtaaaaggggcaatggaagaaagcggcgcggtactgatcaagcgctacggctttgatgctgacaaacatgcggcatacatccagaaaatcctcggtcgtttcgagaacccgtacctgaaagatgatgtagaacgcgtaggccgtcagccgctgcgtaaactgagtgctggcgaccgtctgatcaagccactgctcggaaccctggaatatggtctgccacataaaaacctgattgaaggtattgccgctgcaatgcacttccgcagtgaagatgacccgcaggctcaggaactggcagcgctgattgccgacaaaggcccacaagccgcgctggcacagatttccggtcttgatgccaacagcgaggttgtatccgaggcggtaaccgcttataaagcaatgcaataatggtggaccaggcgcaggataccctgcgcccgaataacagattgtcagatatgcaggcaacaatggaacaaacccaggcctttgaaaaccgtgtgcttgagcgtctgaatgctggcaaaaccgtgcgaagctttctgatcaccgccgtcgagcttttgaccgaggcggtaaatcttctggtgcttcaggtattccgcaaagacgattacgcggtgaagtatgctgtagaaccgttactcgacggcgatggtccgctgggcgatctttctgtgcgtttaaaactcatttacgggttgggcgtcattaaccgccaggaatacgaagatgcggaactgctgatggcattgcgtgaagagctaaatcacgacggcaacgagtacgcttttaccgacgacgaaatacttggaccctttggtgaactgcattgcgtggcggcgttaccaccgccgccacagtttgaacctgcagactccagtttgtatgcaatgcaaattcagcgttaccaacaggctgtgcgatcaacaatggtcctttcactgacagagctgatttccaaaatcagcttaaaaaaagcctttcaaaagtaagtactttcgcttacttctcctctacctgtttcggacgataaagctgacgataatactccagacgttgtagatataacggcacgctttcatcaggtattccggacggaatcgcgttacggggaggtagttttttcagatactcccggaacgcctggctggatgccatgaaatctacggctttatcgataagaagcggaacgttttcacctaatttgcccatgatgatatctccgtattaccccgcgccgggaatgcgcggccgccaattttagtttagatcccggtataaatgacattaaggaaaacgtgctcaatcctcaataatcacctgcttctgttgactatcttttttctttaaatttcttaactaatcaatgtattgggtgattttttaacgcattaatggttacaatctggaactattacaatgccatcagttgtgaacaaagcacctggtcgcgcatactagaggctataaatttatctctatcagaagtcatcacatgaaagaagtcgaaaaaaacgaaatcaaacgtctcagcgatcgtctggacgccatccgtcaccagcaggccgatctatcgctggttgaagccgcagacaaatatgccgaactggaaaaagagaaagccacgctggaagcagaaattgctcgcctgcgcgaagttcacagccagaaactcagcaaagaagcgcagaaactgatgaaaatgccgttccagcgtgcaatcaccaaaaaagagcaggctgatatgggcaagctgaaaaaaagtgttcgcggactggtggttgtgcacccaatgaccgcgctgggccgcgaaatgggcctgcaagagatgacagggttctcaaagactgcgttttaagttcctttctcgtcgctgtaatcacagcctctcaccatttactcgctcctgctggcacatgcaggagcctgtttcagagatcgaatatttataacgttcttaacattatatattcaatctcctctattctttttagcgcacatgccaggctaaattctgaaaatcagatacaaattaaagaacgatgtatcaatattaacaatgaattgccgcatatcaatgcttgaaacataattaattatttaaatttttcaatcagcttcgcaaatcccaaaataaaacatcactcaactgaatatttacctttccctgccctgtgcctttatccggtgaaacatttgacatcgattgacaccgatcattaaaatccgcgcgattaatattattggctacaaactgaaatcgtttgacatttaataacatattcgcacaaccattaatacaaaaactctctaacaaatttattttgcggatatgtcccactccaatcattcataaaaaaaatgattgtgccgtaattatcaactgtatcgggattatgaaaaggaattcatcctatgaacctaaagaaaacactgttaagcgtgttaatgatattgcaactttgcttattggtagggtgtgactatattgaaaaagcgagtaaggtcgacgacctcgttacacagcaagagttgcaaaaaagcaaaattgaggcgcttgaaaaacaacaagaactcgacaagcgcaagatagaacactttgaaaaacaacaaactaccatcataaacagtaccaaaacactcgctggtgtggtgaaggcagttaaagacaaacaggacgaatttgtctttacagaatttaacccggcacaaacccaatacttcattttaaataacggttctgttggtttggcagggaaaatactgtctattgacgcagtagaaaacggcagtgttattcgtatttcactggttaacttattaagtgttcctgtatcaaatatgggtttctacgcgacatgggggggagaaaaacccaccgacatcaacgcattagcaaaatggcagcaattgctatttagtacctcaatgaactcctccctgaaattattaccaggtcaatggcaagacattaatttgacgctaaaaggtgtctcgcccaacaacctcaaatatctgaaattagccatcaacatggcaaatattcagttcgaccgtcttcaacctgctgaatctccacagcggaaaaacaaaaaataaatgcagcttctgcgcttatatcaaggaatagagagcatcaataatgaataaaatatttaaagttatctggaatccggcaacaggcagttacaccgttgccagcgaaacggcgaagagccgtggtaaaaaaagcgggcgcagtaagctgttaatttctgcactggttgcgggtgggttgttgtcgtcgtttggagcatatgccgaagtatcacttgatggtggtacaagtgctgaaacaaccccactaaccaatggttggattgctattggccatgattcgattgcatcgtcagtagtgcaatcaggagctgctgccgcaatagggtatcaggcaagagctttaggtgaaggaagtactgcattaggttaccaaagcctggcaacaggagatcgtgcaatggctttgggacaaatgtcaaaatcttcaggaaaccgagccgcagcgctcgggagtggtgcaaatgctgctggtgatcattccctggcattagggggggcgactaatgctcaaggtgagtattctgtggcaatagggcgggctgctactacagatagcaactacgcgctttctatggggtatatggcgaaagctaatggactatacagcctggcaatgggtgcaggaagtgctacttcgaacgataacgccatcgcgattgggaacaaaacgcaagccctgggagtgaattctacagccctgggtaatgcaagtcaggcatctggcgaatccagtattgcattaggtagcaccagtgaggccagcgaacaaaatgcgattgcgctggggcaaggtagcattgcaagcaaagtgaactcaatcgcgttgggaagtaacagtttgtcctcgggagagaatgccatcgcattgggagagggtagtgccgctggtggcagcaacagccttgctttcggtagccagtccagggcaaacggcaatgattctgtcgccatcggtgtaggggctgcagcagcgaccgacaattctgtcgctatcggcgcaggatcgaccacagatgcaagcaatacggtttcagttggcaacagcgcaacaaaacgcaaaattgttaatatggcagctggtgccataagcaacaccagtaccgatgccatcaacggctcacagctttatacgatcagtgattcagtcgccaagcgactcggaggaggcgctactgtaggcagcgatggcaccgtaaccgcagtaagctacgcgttgagaagcggaacctataataacgtgggtgatgctctgtcaggaatcgacaataataccctacaatggaataaaaccgcgggggcgttcagcgccaatcacggtgcaaatgccaccaacaaaatcactaatgttgctaaaggtacggtttctgcaaccagcaccgatgtagtaaacggctctcaattgtacgacctgcagcaggatgctctgttgtggaacggcacagcattcagtgccgcacacggcaccgaagccaccagcaaaatcactaacgtcaccgctggcaacctgactgccggcagcactgacgccgttaacggctctcagctcaaaaccaccaacgacaacgtgacgaccaacaccaccaacatcgccactaacaccaccaatatcaccaacctgactgacgctgttaacggtctcggtgacgactccctgctgtggaacaaagcggctggcgcattcagtgccgcacacggcaccgaagccaccagcaaaatcactaacgtcaccgctggcaacctgactaccggcagcactgacgccgttaacggctcccagctcaaaaccaccaacgacaacgtgacgaccaacaccaccaacatcgccactaacaccaccaatatcaccaacctgactgacgctgttaacggtctcggtgacgactccctgctgtggaacaaaacagctggcgcattcagcgccgctcacggcactgacgccaccagcaagatcaccaatgtcaaagccggtgacctgacagctggcagcactgacgccgttaacggctcccagctcaaaaccaccaacgataacgtgtcgaccaacaccaccaacatcaccaacctgacggattccgttggcgaccttaaggacgattctctgctgtggaacaaagcggctggcgcattcagcgccgcgcacggtaccgaagctaccagcaagatcaccaacttactggctggcaagatatcttctaacagcactgatgccattaatggctcacaactttatggcgtagcggattcatttacgtcatatcttggtggtggtgctgatatcagcgatacgggtgtattaagtgggccaacctacactattggtggtactgactacactaacgtcggtgatgctctggcagccattaacacatcatttagcacatcactcggcgacgccctactttgggatgcaaccgcaggcaaattcagcgccaaacacggcattaataatgctcccagtgtaatcactgatgttgcaaacggtgcagtctcgtccaccagcagcgacgccattaacggttcacaactttatggtgttagtgactacattgccgatgctctgggcgggaatgctgtggtgaacactgacggcagtatcactacaccaacttatgccatcgctggcggcagttacaacaacgtcggtgacgcgctggaagcgatagataccacgctggatgatgctctgctgtgggatacaacagccaatggcggtaacggtgcatttagcgctgctcacggaaaagataaaactgccagtgtaatcactaacgtcgctaacggtgcagtctctgccaccagtagcgacgccattaatggctcacagctctatagcaccaataagtacatcgctgatgcgctgggtggtgatgcagaagtcaacgctgacggtactatcactgcaccgacttacaccattgcaaataccgattacaacaacgttggtgaagccctggatgcgcttgataataacgcgctgctgtgggatgaagacgcaggtgcctacaacgccagccatgatggcaatgccagcaaaatcaccaacgttgcggctggtgatctctccacaaccagtaccgatgctgttaacggttcccagttaaacgcaaccaatattctggttacgcaaaatagccaaatgattaaccagcttgccggtaacaccagtgaaacctacatcgaagaaaatggtgcaggtattaactatgtgcgtaccaatgataccggtttaaccttcaccgatgccagcgcagcaggtattggctctaccgctgtggggtataacactgttgccaaaggcgatagcagcgtggccatgggttataactcttttgccaaaggcgatagcagcgtggccatcggtcagggcagctacagcggcgttgatacgggtatcgctctgggtagcagctccgtttccagccgtgtaatagttaaaggttctcgtaacaccagcgtatcggaagaaggtgttgtgattggttatgacaccacggatggcgaactgcttggtgcattgtcgatcggtgatgatggtaaatatcgtcaaatcatcaacgtcgcggatggttctgaagcccatgacgctgttacggttcgccagttgcagaacgccattggtgcagtcgcaaccacaccaaccaaatactatcacgccaactcaacggctgaagactcactggcagtcggtgaagactcgctggcaatgggcgcgaaaaccatcgttaatggtaatgcgggtattggtatcggcctgaacactttagttctggctgatgcgatcaacggtattgctatcggttctaacgcacgcgcaaatcatgccgacagcattgcaatgggtaatggttctcagactacccgtggtgcacagaccaactacactgcctacaacatggatgcaccgcagaactctgtgggtgaattctccgtaggtagcgaagacggtcaacgtcagatcaccaacgtcgcagcaggttcggcggataccgatgcggttaacgtgggtcagttgaaagtaacggacgcgcaggtttcccagaatacccagagcattactaacctgaacactcaggtcactaatctggatactcgcgtgaccaatatcgaaaatggcattggcgatatcgtaaccaccggtagtactaagtacttcaagaccaacaccgatggcgcagacgccaacgcgcagggtaaagacagtgttgcgattggttctggttccattgctgccgctgacaacagcgtcgcactgggcacgggttccgtagcagacgaagaaaatacgatctctgtgggttcttctaccaaccagcgccgtatcaccaacgttgctgccggtgttaatgccaccgatgcggttaacgtttcgcaactgaagtcttctgaagcaggcggcgtgcgctacgacaccaaagctgatggctctatcgactacagcaacatcactctcggtggcggcaatagcggtacgactcgcatcagcaacgtttctgctggcgtgaacaacaacgacgcagtgaactatgcgcagttgaagcaaagtgtgcaggaaacgaagcaatacaccgatcagcgcatggttgagatggataacaaactgtccaaaactgaaagcaagctgagtggtggtatcgcttctgcaatggcaatgaccggtctgccgcaggcttacacgccgggtgccagcatggcgtctattggtggcggtacttacaacggtgaatcggcagttgctttaggtgtgtcgatggtgagcgccaatggtcgttgggtctacaaattacaaggtagtaccaatagccagggtgaatactccgccgcactcggtgccggtattcagtggtaatcatccattaacgaatgggtaaacgccacattgcctgatgcgctacgcttatcaggcctacggggtgattcagcacattcctgtaggccggataaggcgttcacgccgcatccggcaagataaggcgcaccagatcaacaatctgagggcaattctctgatgggaattgcccttttcttcattacctctctcccaggattggccctaccaattcttcgcttatctgacctctggttcacaattccccaattaaaactcacatcaccgttgccaatacataacatctggttaactattcattgtcattatccctacacaacacaattggcagtgccacttttacacaacgtgtgacaaggagatgagcaacagactcattacacggcgtgtgtggactgcaggagacctgcaatgaatctctggcaacaaaactacgatcccgccgggaatatctggctttccagcctgatagcatcgcttcccatcctgtttttcttctttgcgctgattaagctcaaactgaaaggatacgtcgccgcctcatggacggtggcaatcgcccttgccgtggctttgctgttctataaaatgccggtcgctaacgcgctggcctcggtggtttatggcttcttctacgggttgtggcccatcgcgtggatcattattgcagcggtgttcgtctataagatctcggtgaaaaccgggcagtttgacatcattcgctcgtctattctttcgataacccctgaccagcgcctgcaaatgctgatcgtcggtttctgtttcggcgctttccttgaaggagccgcaggctttggcgcaccggtagcaattaccgccgcattgctggtcggcctgggctttaaaccgctgtacgccgccgggctgtgcctgattgttaacaccgcgccagtggcatttggtgcgatgggtattccgattctggtcgccgggcaggtaacaggcatcgacagctttgagattggtcagatggtgggacgtcagctgccgtttatgaccattatcgtgctgttctggatcatggcgattatggacggctggcgcggtatcaaagaaacctggcctgcggtcgtggttgcgggcggctcatttgccatcgctcaatacctcagctctaactttattgggccggaactgccagacattatctcttcgctggtatcgctgctctgtctgacactgttcctcaaacgctggcaaccagttcgcgtattccgcttcggtgacttaggggcgtcacaggttgatatgacgctggctcacaccggttacacggcaggtcaggtgctgcgcgcctggacaccgttcctgttcctgaccgccaccgtaacgctgtggagtatcccgccgtttaaagccctgttcgcttcaggcggtgcgctgtatgagtgggtgatcaacattccggtgccgtacctcgataaactggttgcccgtatgccgccagtggtcagcgaagcgacagcgtatgccgccgtgtttaagttcgactggttctctgccaccggtaccgccattctgtttgctgccctgctctcgattgtctggctgaagatgaaaccatctgacgctatcagcaccttcggcagcacgctgaaagaactggctctgcctatctactccatcggtatggtgctggcattcgcctttatctcgaactattcaggactgtcatcaacactggcgctggcactggcgcacaccggtcatgcattcaccttcttctcgccgttcctcggctggcttggggtattcctgaccgggtcggatacgtcatctaatgctttgtttgccgctttgcaggctaccgccgcacaacaaattggcgtttctgacctgttgctggttgctgccaacaccaccggtggtgtcactggcaaaatgatctctccgcaatctatcgctatcgcctgtgcggcggtaggcctggtgggcaaagagtctgatttgttccgctttactgtcaaacacagcctgatcttcacctgtatggtgggcgtgatcaccacgcttcaggcctatgtcttaacgtggatgattccttaatgattgttttacccagacgcctgtcagacgaggttgccgatcgtgtgcgggcgctgattgatgaaaaaaacctggaagcgggcatgaagttgcccgctgaacgtcaactggcgatgcaactcggcgtgtcgagaaattcactgcgcgaggcgctggcgaaactggtaagcgaaggtgtgctgctcagtcgacgtggcggcgggacgtttattcgctggcgtcatgacacatggtcggagcaaaacatcgtccagccgctgaaaacgctgatggccgatgatccggattacagtttcgatattctggaagcccgatacgccattgaagccagcaccgcatggcatgcagcaattcgtgccacgcctggcgaaaaagaaaagattcagctttgttttgaagcaacgctcagcgaagacccggatctcgcctcacaagcggacgttcgttttcatctggcgattgccgaagcctcacataacatcgtgctgctgcaaaccatgcgcggtttcttcgatgtcctgcaatcctctgtgaagcatagccgccagcggatgtacctggtacccccggttttttcacagctgaccgaacaacatcaggcggtcattgacgccatttttgccggtgatgctgacggggcgcgtaaagcaatgatggcgcaccttagctttgttcacaccaccatgaaacgattcgatgaagatcaggctcgccatgcacgcattacccgcctgcctggtgaccataatgagcattcgagggagaaaaacgcatgattatttccgcagccagcgattatcgcgccgcagcgcaacgcattctgccgccgttcctgttccactatatggatgggggggcatattctgaatacacgctgcgccgcaacgtggaagatttgtcagaagtggcgctgcgccagcgtattctgaaaaacatgtctgacttaagcctggaaacgacgctgtttaatgagaaattgtcgatgccggtggcgctaggtccggtaggtttgtgtggcatgtatgcgcgacgcggcgaagttcaggctgccaaagcggcggatgcgcatggcattccgtttactctctcgacggtttccgtttgcccgattgaagaagtcgctccagctatcaaacgtccgatgtggttccagctttatgtgctgcgcgatcgcggctttatgcgtaacgcactggagcgagcaaaagccgcgggttgttcgacactggttttcaccgtggatatgccaacaccgggcgcacgctaccgtgatgcgcattctgggatgagcggcccgaacgcggcaatgcgccgctatttgcaggcggtgacgcatccgcaatgggcgtgggatgttggcctgaacggtcgtccgcatgatttaggtaatatctcggcttacctcggcaaaccgaccggactggaagattacatcggctggctggggaataacttcgatccgtccatctcatggaaagaccttgagtggatccgcgatttctgggatggcccgatggtgatcaaagggatcctcgatccggaagatgcgcgcgatgcagtacgttttggtgctgatggaattgtggtttctaaccacggtggccgccagctggacggtgtgctgtcttctgcccgtgcgttgcctgctattgcagatgcggtgaaaggtgatatcgccattctggcggatagcggaatacgtaacgggcttgatgtcgtgcgtatgatcgcgctcggtgccgacaccatactgctgggtcgtgctttcctgtatgcactggcaacagcgggccaggcgggtgtagctaatctgctaaatctgatcgaaaaagagatgaaagtggcgatgacgctgactggcgcgaaatcgattagcgaaattacgcaagattcgctggtgcaggggctgggtaaagagttgcctgcggcactggctccgatggcgaaagggaatgcagcttaagggttagacgaatatctgctatcctgcccccgcactaagggggcagtatgctaaacatcgtactttacgaaccagaaattccgccaaatactggcaacatcatccgtctttgcgctaataccggctttcgtctgcatatcatcgaaccgatgggatttgcctgggacgataagcgcctgcgccgcgcggggctggactatcacgagtttaccgccgttacgcgtcatcatgactatcgcgcgtttctcgaagcagaaaatccccagcgtctgtttgccctcaccacgaaaggtacgcctgctcacagcgccgtaagctatcaggatggcgattatctgatgttcggcccggaaacacgcggcctgccagcgagcattcttgatgccctgcccgctgaacaaaaaattcgtattccaatggtgccggacagccgcagcatgaacctgtccaatgcggtgtcggtggtggtgtatgaagcctggcgccagctggggtatccgggagcggtgttgagagattaagatgcggtaggccggataaggcgttcacgccgcatccggcacgatcacaggacatcagatcccatcaccatactcaaacgtatggttaataccgttgaagtgctggtccatatccattgatggcttatcgctgtctggtttaccgacaatgcgtgccggaacgccagcggcggtggtatgtggcggcaccggttgcaacaccacggaacctgcgccaatcttcgcgccgcgcccaacttcaatattgccgagaattttcgcgcccgcgccaatcatcacaccttcacgaattttcgggtgacggtcgccaccagatttacccgtaccgccaagcgtcacagattgcagaatcgatacgtcgttttcaatcaccgccgtttcaccaacgacgatgcccgtcgcgtggtcgagcatgataccgcgaccaatttttgctgccgggtgtatatcaacctggaacgttacagagacctggttttgcagaaatattgccagtgcgcggcggccctgattccacagccagtgaccgatacgataggcctgcaaggcatgaaaacctttcagatataacaatggagtcgagtatttatccaccgccgggtcgcgggtacgcactgcctgaatatcacaggccgcagaagcgatcatttccgggtcggcggcgtaggcttcttccaccacttcacggatagcaatagcaggcataatgggcgatgacagcttgttcgccagcatgtagctcagtgcactgccaaggttttcgtgcttgagtagcgtcgcgtggtaaaaactggccagcattggctcacagtccgccagcgttctggcttcagctttaatattgttccagacaatttccagttcttcacacgacattgcttactccacacgataagataatgaccgacccgttctgcgcgggccgggtcatagtggtaacaaaggttccctgggtttagtggctgctgcgctcgtccttgcgtgcacgacctagtaaagtcaatgctgcctcgcgcgcgttttttccgcaatataatacttgataaatttcctcggttattggcatttcaacgccgaagcgatgcgccagttcgcggacttctttcgtattgcggtagccttccaccacctgacctatcttttcctgcgcgctttgtacatccatgccctgaccgagcatcatgccaaaacggcggttacgcgactggttgtcggtacaggtaagcaccagatcgcccagccccgccattcccataaaggtggcaggatcggcacccagcgccgcgccaagacgcgacatctcagccagcccacgagtgatcagcgccgtacgcgcattcgcgccaaaaccgataccgtcggacatccccgcgccaatggcaatgacgtttttcaccgcgccgccaagctgcacaccgatgaaatccgggttgctgtaaacgcggaaacttttgccacagtgcagcaattgctggaggtcatcggcaaaggtctggtccgtcgaggccagcgaaatggccgtcggtaaacctgccgccagttctttcgcaaacgttgggccagagataaccgccagcggaatttgatcgcctaaggcctcacgcgccacgtcctgtaacagacgtccggtttctgcttccagccctttggtcgcccacaccagacgcgcatcaggacgcatcagcggtttaatctggcgcagcacttcaccaaagacatggctgggtacgacgacgagaatattacggctggctgccagcgcagtggcgagatcgctttcaagatggagcgtatcgggaaaaggcacatcggggagaaacgcggcgttacagcggtcgcgttcaagcgttgcgatatgttcagggtcatggccccagaggacaacctcgtggccatttcttgccagggtgatggcaagagcggtgccgtacgagccggcaccgatcacagtcattgaagcattacgttggttcatcaggcatcctgatgttcttcagtaccttcgccagcctgctgctgcaaatagttcatgaacagcgcatcgaagttaaccggcgcaaggttcagttgcgggaatgtaccgcgggataccatgctggtgatgcactcacgagcatacgggaacagaatgttcgggcagtatgcgcccaggcaatgtgccatctgggtgccttcgatacccgcgatggagaaaataccgccctgctgaacttcacacaggaacgcggtttcttcgcccagggaggccgttacggtaacacgcagtaccacttcgtaaacgtcatctgccagttgagtagatgccgtatccagatcaagtttaacttctggttgccaatctttctggaaaacgtgcggcgcgttcggcgcttcgaaagaaatatccttggtataaatacgttggatctggaaagtcatttcggtgttgttttgttctgacatgtgtagaaaacccttaagtgttgtccttaaaatactgcgcaatgtaatgccaacgttcacacgttatttcagcaggggatccagtccaccacgtgcatccaatgcatacaagtcatcacagccaccaatgtgctgtgcgtcaataaaaatctgtggaaccgtggtgcgaccgctgcgtttgatcatctcttcacgcttagcggcattgccatcgatcggcaactcctgaaaactcacgcccttgctgctcagcagtgcttttgcacgatggcaatacgggcaggtttctttggtatagatttcaacattggccataaattagctcctgttttttaccctgaaatttcatgttgcagggcggcagcaaaatggagtgtccccagaagcttatatcaataagtcgctgggggcctaattgcagctaacggcctgcatcatgaaagacgacaggtaaattatttgccgcgcaccaaaggcaagttttcgccagcccagccagcgacgccttctttcagtacgaatacttgcgcaaaaccagctttcgtcagcgcgtttgcaggctcctggcactgcatgccagaaccatctaccacgataaccggtttgtctttgtgcttctcaagctcaccaacattgttggctttgatttcgctcggcaacaggttgatagaacctgcgatatggcctttacggaagtcatcacgctgacgtaaatccacaaccacagcgtcttctttgttgatcagacgcgtagcttcaccacgagtaatcaccttcactttcgaggtcaggctcttaaacgtagtcacaagaaccgccaccagtaacgcgatccaggcgatactcagtatgggatgacggccaacaaattgcataatttcttgcatggggggtaacaactcccgacgtagtgattaaaaaaaccaggaaaggagtatacctgcgcgttgcggcaaatacagccagcgcgttaactggaatgcaattttgcggggcgctacgaaaaaaaagcgtaaatctggcatctgcttgccgcgagcggtcgtatattttgatcttcagaggctattttatcgattcagctgtagtaaaattacgcaaattttgactcttgagtatgaggttgtcgcaatgtcggtttctaaaaaacctatggtactggtgattctggatggctatggctatcgcgaagaacagcaggataacgccatttttagtgctaaaaccccggtaatggatgcactgtgggccaatcgtccgcataccctgatcgacgcttccggtctggaagtcggtctgcctgaccgtcagatgggcaactccgaagtaggccacgttaacctgggtgccggccgcatcgtgtatcaggacctgactcgtctggacgttgaaatcaaagatcgcgctttctttgctaatccggtgttgactggtgcagtagataaagcgaaaaacgcaggcaaagcaatacacattatgggtctgctctccgcaggtggtgtacacagccacgaagatcacatcatggcgatggtagaactggcagctgaacgcggcgcagaaaaaatctacctacacgcattccttgacggtcgcgacactccgccgcgcagtgctgaatcctcgctgaaaaaattcgaagagaaatttgccgcgctgggtaaaggccgcgtagcgtccatcattggtcgttactacgcgatggaccgcgataaccgttgggatcgcgttgaaaaagcttatgacctgctgactctggcgcaagatgagttccaggccgataccgccgttgccggtttgcaggctgcttatgctcgcgacgaaaacgacgagttcgtgaaagcgaccgttattcgtgcagaaggtcagccagatgcggcaatggaagacggcgatgcgctgattttcatgaacttccgtgctgaccgcgcgcgtgaaatcactcgtgctttcgtgaacgctgatttcgatggcttcgcgcgtaagaaagtggttaacgtcgatttcgtgatgctgaccgaatacgctgccgacatcaaaaccgcagtggcttacccacccgcttccctggttaacaccttcggcgagtggatggcgaaaaacgacaaaactcagctgcgtatttccgaaaccgaaaaatatgcccacgttactttcttcttcaacggtggcgtagaagagtcgtttaaaggcgaagatcgcattctgatcaactcaccgaaagtggctacctacgatctgcaaccggaaatgagctccgcagagctgaccgaaaaactggttgcggcaatcaagagcggcaaatacgacaccattatctgtaactatccgaacggcgacatggtaggtcacaccggagtgatggaagcggcggttaaagcggttgaagcgctggatcactgcgtggaagaagtcgcgaaagcggttgagtccgtgggtggacaactgctgatcaccgctgaccacggtaacgctgaacagatgcgcgatccggcaacgggtcaggcacacacagcacacaccaacctgccagttccgctgatttacgttggtgataagaacgtgaaagcggttgaaggcggcaaactttctgacatcgcgccgaccatgttgtcgctgatgggtatggaaatcccgcaagagatgactggtaagccgctgttcatcgtggaataatccctccccatgaggggaaaggcgattaataccatgacacgggccgtgaaaccgcgcaggtttgcaatcaggcccatcatctacgccagcgttctgagcgctggcgtattgttgtgcgccttttccgcccacgcggatgagcgtgaccaactcaaatccattcaggctgacatcgccgcgaaagagcgcgcggtacgccaaaagcaacaacaacgcgcaagcctgctcgcacaattgaaaaagcaggaagaagcgatctctgaagccacccgtaaactgcgcgaaacgcaaaacacgcttaatcaactgaataaacagattgatgagatgaacgcgtcgattgccaaactggagcagcaaaaagccgcccaggagcgcagcctcgccgcgcaactggatgccgcgtttcgtcagggtgaacataccggtattcagctgattctcagcggtgaagaaagccagcgtgggcagcggttacaggcttatttcggctatctcaaccaggcgcgacaagaaaccattgctcagttgaaacaaacgcgtgaagaagtcgctatgcagcgtgccgaactggaagagaaacaaagcgagcaacaaacgcttttatatgagcagcgcgcccaacaggcgaagctgacccaggcgttgagcgagcgtaaaaagacgctggcagggctggagtcttccatccagcaaggtcagcaacagttgagcgagctgcgcgccaacgaatcccgcctgcgtaacagcattgcccgtgcggaagctgcggcgaaagcgcgtgctgaacgtgaagcgcgcgaagcccaggcggttcgcgaccgccagaaagaagcgacgcgcaaaggcaccacctacaagccgaccgaaagcgaaaaatcgctgatgtcccgtaccggtggtctgggcgcaccgcgcggtcaggcattctggccagttcgcgggccaacgctgcatcgctatggcgaacagctacagggtgaattacgctggaaagggatggtgattggtgcctctgaaggtactgaggttaaagcgattgccgacggtcgggtgattctggctgactggctgcaaggctacggtctggtggtggtggttgagcatggtaaaggcgacatgagtctttacggctataatcagagcgcactggtgagcgttggttcgcaggttcgcgcgggccagccaattgcactggtgggcagcagtggcggtcagggtcggccttcactctatttcgaaattcgccgccagggtcaggcggtcaatccacagccgtggttgggaagataagttttgtttccatttcgtcgtaacgttcttgcatttgccgctctgttggcgctctcctcccccgtaattgctggcaaacttgccatcgtcattgatgattttgggtatcgcccgcacaacgaaaaccaggtgctggcgatgccttccgctatctccgtcgctgtattacccgattcaccgcacgccagagagatggcgaccaaagcgcataacagcggtcacgaagtgttgattcatctaccgatggcaccactgagtaaacagccgctggagaaaaatacgctacgcccggagatgagcagcgacgaaattgagcgcattattcgtagtgcggtcaataacgtgccctatgccgtggggatcaacaaccacatgggcagcaagatgacctctaacctgtttggtatgcagaaagtgatgcaggcgctggagcgttacaatctttacttcctcgacagcgtaaccatcggtaatacccaggcgatgcgcgccgcgcaaggcactggcgtgaaggtgatcaaacggaaggtgttcctcgacgattcgcaaaatgaagcggacatccgtgtgcaatttaatcgcgcaattgacctggcacgtcgcaacggttcaaccattgccattgggcatcctcacccttcaacggtacgcgtgctacaacagatggtttataacctgccgccagacattacgctggtgaaagccagcagcttgctgaatgaaccgcaggttgatacgtctacaccgccgaaaaacactgtgcccgacacaccgcgtaatccattccgtggcgtgaagctgtgcaaaccgaagaagccgttggaacctgtttatgctaatcgcttctttgaagtattaagcgaaagcatcagccagagcacgctgatcgtttacttccagcatcagtggcaaggctggggcaaacagcccgaagcggcaaaacttaacgctagcgcaaattaaaggcactacgcgtaatgcgatggtgcgaccgcgttttgtcgcgccattgccataagcggaaagaccacagtaacgcctggtaacccaccttcacgctgcgcacattggtaatcaggcgcttatacataccggaagtaaatatctcggcaatcatccgttggcgggtaataatatccggctctttgcgcaccgcatggcaaacacgcaatgcttcgtaagttatttgctgatgaaattccggataaatcgtaattttgtcggcataatttcgatttaatttctccagcaggcgggtaatcttaatatagtgacgttgataattaaggtttttattcccttgtctatgcaaccgactcactgacgtattatgcagataatatttatataatgattgctcggtatatcgcgcacgcagcgcgttaaacataaattctgttgtccagacaatatcctgatgatgtaatccggcaataaatctaatgttatttttaacaataacatcgcggcgataaacccccatccagaccacgtgtgtccaacggcgggaagaaagtcccatccgcagccagtccggaccagttaatacaccggttgagcgaaggcgatcggtagggatggattgccaggtttcacccgtttcacgaaaacaccaatcagcgttgcactgcgccacgtcgaggtcgtcctctaacgccatggtcatcagcgtttcgtacatggtgggatagacctcatcgtcagcatcgacaaaagcgacatattttcccgttgccacttcaatcccacgattacgcgccaccgatgcgccagcattcgcctgatgcaacaaacgaacgtgcggatagttttctgcgtaatgctttgctatttcaacagaattatccgttgaaccatcgttaataataatgatttccagagcagtccatgtttgcgtaattaaagattccatacaagtgcggaaatcattgcccgcattatataacggaataataacactaagtttattggtgctgttcatcataaattaccgacgacctctgaagttatcctgacgttttacaggctttgtattaagaaactattaagcctgtgagatattatttttaccggtgagagagtcacgtcagggtagagagataatgagagcagctatataagagatcagcgcaattacgatatcttgattacactgacaggattttacatatttaacggattatcctcaggcaaaagggctggaataccagcccttgttcgtgttaatcccagctcagaataactttcccggactggcccgaacgcatagcgtcaaagcccttctggaaatcatcgatagagaaacgatgggtaatgatcggcgagagatcgaggccagactgaatcagcgccgccatcttgtaccaggtttcaaacatctcacgaccgtaaatacctttaatgaacaagcctttaaagattactttggtccagtcgatagacatatcggacggtggaatacccagcatcgcaatacgaccgccgtggttcatggtgtcgagcatggtacgaaacgctggcggcgcaccggacatttccagaccgacatcaaagccttcggtcatgcccagttctgtcatcacatcattaaggttttctttagcgacgttaaccgcacgggtgatacccattttgcgtgccagctcaaggcggtattcgttaacatcagtgatcaccacattgcgtgcaccaacgtgtttcgccaccgccgcagccataatacctatcggacctgcaccagagaccagcacatcctcgccaaccagatcgaacgacagcgctgtatgcacagcgttaccgaagggatcaaaaatggaagccaggtcgtcggagatattgtccgggattttgaaggcgttgaacgccggaatcaccagatactcggcgaagcagcccggacggttaacaccgacgccgatcgtgttgcggcacagatgggtacgaccgccacgacagttgcgacagtgaccgcaggtgatatggccttcgccagaaacgcgatcgccaatcttgaagcctttcacttcctgaccaatacctaccacttcaccgacatattcatggcccacgaccatcggcaccgggatggttttttgcgaccactcatcccagttatagatgtgaacgtcagtcccgcagatggctgttttacggattttaatcagcagatcgttatgcccgagttccggtacaggaacgtcggtcatccagatgccctcttccgctttcagtttggataacgctttcatctcacatcctcaggcgataacgcccagttgtttaccaatacgcgtgaatgcttctactgcacgcgtaatttgctcaggggtatgcgccgcagacatctgggtacgaatacgcgcctgacctttaggaacgaccggatagaagaaaccggtgacgtaaatgccctctttttgcagctcacgggcaaatttctgcgccactaccgcatcaccaagcatgaccggaataatggcgtgatcggctcccgccagggtaaagcccgccgccgacatttgctcacggaactgacgcgcgttcgcccacagacggtcacgcagttcgctgcccgcttcgaccatctccagtactttgatggacgcggcaacaatggccggtgccagcgagttggagaacaggtacggacgagaacgctggcgcagccactcaaccacttctttgcgcgccgcggtataaccaccagaagccccgcccagcgctttacccaacgtaccggtaatgatgtctacacgccccatcacatcgcagtattcatgggaaccacgaccattttcaccgacaaaaccgaccgcgtgggagtcgtctaccatcaccagggcatcgtatttatctgccagatcgcaaacgccctttaggttggcaatcacgccgtccatcgagaacacaccatcggtggcaatcagcacatgacgcgcaccggcttcacgcgcttctttcagacgtgcttccagctcctgcatatcgttgttggcataacgatagcgtttggctttacacagacgcacaccatcaataatagacgcgtggttcagtgcgtcggagataatggcgtcctccgcgctcagcagcgtttcaaacaggccaccgttagcatcaaagcaggaagagtagagaatcgcatcttccatccccaggaatgccgccagtttttgttcaagctctttatggctgtcctgggtaccgcaaataaaacgcaccgaagccatgccgaaaccgtgagaatccattcccgcctttgccgccgcaatcagatccggatgattcgccagtccgagatagttgttggcacaaaagttaatgacgtggcttccatcagccacagtgatatctgcttgctgcgcagacgtaataatgcgctcttctttaaacaacccttccgcccgtgcggtttccagatcgttggttaactgctgataaaattctccacgcattgcgattctccagacagggcaaattccagcacatattacccaaacttataggtcgcgacgagatgacgcgttaacacttctgcaaaattcaggataaataacgtgtatcttgatgtctcttaacacctacagatagtagaaaaactgtacagttttggctgggcataatgatgagtgattttactgcatttctataaaaagaaaaaatgatgccagagcatcatttttccaatctcatttggtatcaaaacgctacccactaatggagggaaacctattttcttgaaaggaaaattctcagcgcctgcatttttgcccctaaagtgttactcctgaagcagcgaaacaaatcgaaccattttcctctccccagatagtttaggttgaagagatcggaacgtttgtaatagcacatgacaaaaatgccctggtcatcgtccacaatgttattgtttagggttattttttgactttccagaactaatttatagaattctttccatttatgctgtgaaccaacaattgcgccaccaataatatatacatgattgccaatcatgaaatcaaaagcctgttgttgagatgtaacagcaagccctttttttatagtgaaaagatgcatcttattttcatcaaatgggaaatcccaaattttcaatcctcgagttacatttggcttacggcaatagccaaaatctatccacgcaacaagaggagttttcactaagcccatgttgatagctttatttacaaaataggccttaaggttacataccaatacatactctggtgaccagtactctgggttttttaattgccgcggctcaagtctatttgtaaacgactcatctttttgaattttttcgatacgacttctgatatatctaaatttcttttttatatcgataacgataaccgttgttggttttccgttgcgaatcgcttcaacccttgatttcaaatcgggagaagtgaaaataatcatttcattttcaagtgcggccagacgctcaaagtaactaaaataaacatcaactgaacgagctagtttttcacggaaccctttattagcagtccaatcccctctaccaatgtcaaaatatgcagtgataattgtggtggatgatttcattactaataagaccattaatataaaaaaagaattatatcataaatattaacagaatgtatactgtatattatccattcaaatgtttcagttatttatcatacatcggaatattgatactaaagcactattcacgtgcaaatccaacatccgccatgaaggactggctaaaacccaaactagtttgttgcaattagcatccttgcatctctatgtaaagggctgaagggattcggatgtgatggtatgattacagacattcgtgtctgagattgtctctgactccataattcaaaggttacagttatgatcatcgttaccggcggcgcgggctttatcggcagcaacatcgttaaagccctgaatgacaaaggcatcaccgatattctggtggtggataacctgaaagacggcaccaagtttgtgaacctggtggatctggatatcgcggactatatggataaggaagacttcctgatccagattatggctggcgaagagttcggcgatgtcgaggcgattttccacgaaggcgcgtgctcttccaccaccgagtgggacggcaagtatatgatggataacaactatcaatactccaaagagctgctgcactactgtctggagcgcgaaatcccgttcctgtatgcctcttccgcagccacttacggtggacgcacctccgactttattgaatcccgcgaatatgaaaaaccgttgaatgtctacggttactcaaaattcctgtttgatgaatatgttcgccaaatcctgcctgaagcgaactcgcagattgttggcttccgttatttcaacgtttatggaccgcgtgaaggccataaaggcagtatggcgagcgtcgctttccatctcaacacccagcttaataacggtgaatcaccgaagctgttcgaaggtagcgagaactttaaacgtgacttcgtctatgtgggcgacgtggcagatgtaaacctgtggttcctggaaaatggcgtttccggcatcttcaacctcggcaccggtcgtgcggaatccttccaggcagtagcagatgctacgcttgcttatcacaagaaaggccaaatcgaatacattccgttcccggataaactgaaaggccgctaccaggcgttcactcaggcagatctgacgaatctgcgcgcggcgggttacgataaaccgttcaaaaccgttgccgaaggcgtaacggaatacatggcctggctgaatcgtgacgcataagagctctgcatgaaaatactggtgatcggcccgtcttgggttggcgacatgatgatgtcgcaaagtctctatcgcacgctccaggcgcgctatccccaggcgataatcgacgtgatggcaccggcatggtgccgtccattattatcgcggatgccggaagttaacgaagcgatccctatgcctctcggtcacggagcgctggaaatcggagaacgccgcaaactgggtcatagtctgcgtgaaaagcgctacgaccgcgcctacgtcttacctaactccttcaaatccgcattagtgcctttcttcgcaggtattcctcatcgcaccggctggcgcggcgagatgcgctacggtttactcaacgatgtacgcgtgctcgataaagaagcctggccgctaatggtggaacgctatgtcgcgctggcctatgacaaaggtattatgcgtaccgcacaagatctgccgcagccattgttatggccgcagttgcaggtgagcgaaggtgaaaaatcatatacctgtaatcaattttcgctttcatcagaacgtccgatgattggtttttgcccgggtgcggagtttggtccggcaaaacgctggccacactaccactatgcggagctggcaaagcagctgattgatgaaggttatcaggtggttctgtttggctcggcgaaagatcatgaggcgggcaatgagattcttgccgctttgaatacagagcagcaggcatggtgtcggaatctggcgggagaaacacagcttgatcaagcggttatcctgattgcagcctgtaaagccattgttactaacgattctggtctgatgcacgttgcggcggcgctcaatcgtccgctggttgccctgtatggaccaagcagcccggacttcacaccaccgctatcccataaagcacgcgtgatccgcctgattaccggctatcacaaagtgcgtaaaggtgacgctgcggagggttatcaccagagcttgatcgacattactccccagcgcgtactggaagaactcaacgcgctattgttacaagaggaagcctgacggatgcgggttctgatcgttaaaacatcgtcgatgggcgatgttctccacacgctgcccgcactcactgatgcccagcaggcaatcccagggattaagtttgactgggtggtggaagaagggttcgcacagattccttcctggcacgctgccgttgagcgagttattcctgtggcaatacgtcgctggcgtaaagcctggttctcggctcccataaaagctgaacgcaaagcgtttcgtgaagcgctacaagcaaagaactatgacgcagttatcgacgcccaggggctggtaaaaagcgcggcgctggtgacgcgtctggcgcatggcgtaaagcatggaatggactggcaaaccgctcgcgaaccgttagccagcctgttttacaatcgtaaacatcatattgcaaaacagcagcacgccgtagaacgcacccgcgaactgtttgccaaaagtctgggctatagcaaaccacaaacccagggcgattatgctatcgcacagcatttcctgacgaacctgcctacagatgctggcgaatatgccgtatttcttcatgcaacaacccgagatgataaacactggccggaagaacactggcgagaattgattggtttactggctgattcaggaatacggattaaacttccgtggggcgcgccgcatgaggaagaacgggcgaaacgactggcggaaggatttgcttatgttgaagtattgccgaagatgagtctggaaggcgttgcccgcgtactggctggggctaaatttgtagtgtcggtggatacggggttaagccatttaacggcggcactggatagacccaatatcacggtttatggacctaccgatccgggattaattggtgggtatgggaagaatcaagtagagtgtcgttctacaagtatgtctcttgcagatttgccagctcaaaccgtttttcaaaatttaaatcttgaaataataatcaataagttgacatcggagataagatgacctcaacattatttttctctttcgagaaaaaaaactggatagcgtactggaacagagctcttgtattcttattcattaccacctattttttgggtgggattacaaggtataaacatcttattgttattcttatgacaataacgacaatcgtctatctctgcaaacggccaaaacattatctatcattatttaaaacatttctttttggtagtgttgccatattaactattgctgcattgctatcacttgttcaatccccagatgcaggtgctggcatgaaggaaattttcaaagctatcattgaaaatactttgctatgcacaatagcaataccggttatattgagagacgagaaaagagaagatatcgaaaaaatcgttttcttctcatttattagtgcgttaggcttacgctgtttttctgaattgattgcctattataaggactatcaacaagggataatgccattcgcagattatagacaccgtagcatttctgactcgatggtttttttattccctgcattgttaaatctctggcttatcaaatcagcaaaataccgcatttcttttgcggttctaagcgctatttttatttttctgatattaggaactttatccagaggggcctggctttccgtgttagtcattggattaatatggattctgatgtttaaacaatggaagttactattagtaggagtaatggtttccatcattgcattgtcggttattttcacacataaggagatgaccgcaaagctaacgtataaacttcaacaaactaatagttcttatcgttatgcaaatggtactcaaggcagcgcactcgatctaatattagaaaatcctgttattggttacggttacggtaacgttgcatataaagatgtctataataaacgagtcattgattatccgcaatggacctttagacaatcgatagggccacataattttgcgctattcatctggtttggcactggtttattagggctggtaagtcttatgatgctatactgtgcaatactaaaagagtgtataaaaaatgtcgtccagaataaataccgctcaccatataatgcatattatataatcttactatcttttataggttattttgttatccgtggaaacgtagaacaaattgaaccaaatttattaggcgtttacgccggcttattattagcgatgaaaaacaagtaaaaaataaaaaggctgcataatgcggcctttttatttattcaaaccaattatgaataacctcttcaaatctttgagttacgccatcccaactgtagtgatcaaacacaaaatcctgaccttgctttgcaactgctgttaattcaggattcgctaacgtttttaaaatatcgctgcttatagagtctgcagtcataggttcttttaaatggaatcccgtagtattttctttgacaaattccgtcatccccccacgcgtactcactaaaacaggcttaccagcccccatagcttcaattgccaccatgcaaaatggttcctggaactgggaaggaatgacgactaaatctgccagagggtaataacaatgcatcttttcaggcggtatgcttcctaacataatgcaacgatccttcaaacggtttgcaatttccctgacattgcgttgatatgcacctttgtcacttttactcatttctgtataatcaccaatcacaactaattttaaatttttgtgagcagctgccaatttttcgaatgattgcatcaacagtagtatgcctttgtcagggacgatacgcccagcataaaaaataattttctcttcagcggagatattaagttcgcttctagtgatcggctgaaaagtagattgataggtttctaaatcaattccatttggtacaatctcaatatctgcatttgctaaataagattggtaatactttttcaagtataaactaggcactatcattttaacattttgctcaagcaattttggttcaaatgcattatgcatatgtataaccactcttgcctgaggtgctcgcttacgaatttgagaatatagcttcatgctattatgaactacaataacactttctttcgttataggaaaatcatgtgcaatattcaatattctctgtgaatatggaagaggatcaagtcttgtccatttttgaaataaccgcttatatatgcggctgaatccaaccctatgaatactacaattatcattaacaaaggtataatttgagtatcctggattcttgatacaaacaatacgatttgggaaattggtacgctgagcaacctggtacatccacgtttcaacagcggccgctccgcgaggaggaattgaaaaaataggagtaactgtaaatattattttatcaaccatctcgaatattaacctttcataacattatatttaattgctgtaaaaacaccatcaagaaattttttctggtaaagcaagtgtttatatttttctttgtactcatgttttttaacagcttttttataaggtatatttctccatggcgatatattataaatattacgaaaataatctgcagatgcgtagttcgcccaatcatgccatggcttagttacaccagtataatgtatgaagacagtttcatcattaataaaccgggtgtaatattcactatttttttcttcaaattctgactttattgtataaatacaattatattttctcggtaatatttttgcatggtgtagaaacatcaagtttaaaatatcttgatccggatactttaatttttttataattgattcatctgataatagatcaaagaatttctccgttagcctttgttttaaccattcccgtaaattaatatacattacaccagagttaaaatagataccgttaaaatcctcattacacaaacgctcagcacttttactttgcatggcatctacatcaattaccacggccccatattcatctttaaactctaatgctattaactcgttcaatgaccccttacagacgatatcagcatcaagatataataatgaatccaatcgcgcagaaaaataatcaaatgaaagcaaacgataataaatagatactggccagatatttgattgaggtagctccttcaatggctcagaatcaatatgatataatttaattactgtttgatacttcgttgctaattgtgataataattcaatatactctttgtctaggtaatcagcgattatgtgaaaggtaaatttgttttgcttattattttcaagaattgaagcaattgaaatcgcagccccaacttggtaattctcatcaataccccatgagacattaaacgtttcccgttcatcaagtttaacggggcgcttgtccagttcaattatatctttaaattgagtaagatgtttaaaatccaatttaattacccttcatcataattattatttgctcttcaatcctagtttgacttttacatccctgattgcttttttaattttctttttgaatataagatatgtatagccaaagtctttcaattcattttttatattatagtgccgttcaagatcaatgcgatcttttgcttttaaaactgcggttgtttttttacctgaaaggtcaattagtcttaaacctttttcggatactataaaatttcctttatgaggatcgccagacaccattccatgctgatgcaactcttttatcgattctgataattgattcttcagatcttcagaaatttccaaatactcatttaacccgacaccttcaatatactcaatgagcataatataataatgcgcgaaatttaatgttttacgttcagcaagcaaataatagtcattaattgattggatgccttcaccacgtacccgatcggtttgataaattaaattttcataataatctttttttacgcaagattttaagaaacgttcgatcattttatgctttggcgcataaactttaagtacaagaggtccacgagcagtgtcaataagaataactttagtatcagcaatagaacgaaaaacttttaatgttttaaccctgcaagttaaaaagtcattcagaactcgttcataaaagggatcattatcttttataaaaactttcaacccacttatcgttttattatatatcataatgaattattttaaccttaaatctttagaagcatttttctttataatactttaaataattaaaaatgcctgccatataatgcttttgtttaaatttatgttttgcacaataccgatactgattgctatttacaggtttaagtaaatcttctttactccacggagaagctgctttggcgatcaaaaaactacgtgacaccggataatcagcccactcatgccagggttttgtaggtcccacatagtgtataaacacggtgtcatcattgactggattatcaactttgtcttttaattcatagttaatactatatcgggtattatatttccccgaaataaacttcactttaccattcaataatacattcagtacatcttgatcaaggtgggtgattttacttacccaatctgggtcacgcaacatttcaatagcttttgacgaaatgttatttagattccactcatcaatatttatcagtaaaaaaccagcattgaaatatccagaagctaattgtggtgtagttaataccgaggctcgattctgccaccattcaacatctctttcagccacaactgcggcaatttcattagtagaaaattgataatctaagagttctttaatactacccttgcaagcaatatctgcatcaagatatagtatttttttatgtttattatagaaataatctgcaattataaatcgaaaatatgttgcgtaagtccagtttttcgtgcttggtaatgacttcagcttatcacaattgataacataaatattaattcttgaattatattgttttgctaaatcggaaaaatataacttgtctttatcactgatataatctgtgaaaacatgaaattcacaagaaatttcgctattgtttaatagaatagatgcgatggccacaccacatccaaaaagaaaatttctgtcaataccaaatgctatatcaagagtatttttagatcttatattttgataatgaaatttatactcaaaaaggatgatgtcactatcattgagttgagacatatttattctgtatccaaaattttggcaaaaataagttacgggttacaacgattttcgaatcgttctttccctgatttttgtggcttttgcttctgcttgcgacagcagcccttgttcctgcttgataatgtctttaagcggggcgacaaaatacactttcataaaccgccagatatcccgctgagtcaggccaatattcatcgaagaaaaataaagtccaataagatctttatcgcgccaacgacgtggaacgcgcgtgcgaagctgcgcccggtgcaggtcaattactgaaatttttaactcctcttccttaccggaaaaaggcaagtgcagcaggaaatgacagatataacagtcacggtggttaatgcccgcagcatgcatatcgcgcaccatcgtcgcgacacgcttaataagcatacgctttacgcgaacatctggtgggttggtcgcccagtcagcacagtaatcttccagactgatggttggtgtcagatcttcggtaataataaacgaggttctggtcagcggattaatgcctttttcgccgaatgccaccccatacatagtatcaacgccgacatcccgcagtcgatgaatcgcattccattcgcggtctgcgcctaatactggcatccgcaatgagagtaaatttttgattatctctttcagggtcgtgccgcgatgccatttgagaaaatagcttttgcccgccatttcaaagcgcagagtgcggcgagtttccagttcacgaaatacctcaccctgcaaggttttaacttcctcaaaaggatctttaccgcgccataacgtggcaaacggctctttaagttcaaccatccagaccacccgttatgatgtccgccgctttctctggcagactgtataaatcttgtgtatcagcataatgtcgcgcattttccgcccatgcctggcgcaatgaagattgcgttaacgctttgcgtaaaatctcattcaatgtttcctggcggaatggctcagcaatagcctcgccgcaattggcgtcgacaatataatgcgcatagccacaaacggctgttgttagtaccggtaatcctgcagttatcgcttccagcagtacaattcccgcggcttcctggtaggcaggatgaagtaataaatccgccgctgccattaattccgagacatcgttgcgccccgagaagaagtgaacattactgcgcacgccgcgtttttctgccagcgcctcaaattttcgcggtttatcctgcccaacaacatatagtaatgtgttgtggcgcagcgaatccggtaacgaagcaagtgcttcaatggaacgatcgacacctttacgcgtgaagtctgaaccaacctgcaacaataaatattgttgttcggttattccattcttcttacggaagatttcacggctattggctggctgctggctatatttacgatcaggataaatccccggaggcagaatatgaaaacgctccgcttcagtctgataatgtttctggaaatcggcgatttgcttatctgtcagcatcagcagctgtgtcggcttgccctgttcgaaggttgcccgctcaaaggcggcataatggcgataacgtgacgtcaggcgatagaaaaagcctttctcctgcgctactttctcggcataacaaacatcagcggcataataaacgtccagccccggcattttattaaatccaacgactctatcgacgggatgttcacgtaaatgtttttgcacccaggcaaaatattccgcattgcgcccgtgattggtatgcgatttaaccggcactttgatcagttcaaatacatcagggcattcgccttcccacgactgggtataaacccgaacatgatgacctcgggcggcaactgtctgagcaatacgcataaaatcgcgctgcaaaccgccaaagggaaaatatttatataaacaaaaagcaacgatcataacgacgtacctgtcgtggaggagggaagtaatttatcgacagctgcaatgacatctgccgccggaataaccgaaagatacatctcatttcggtcacgctgatcgcgcgttggcatttcccggtaatctcccgcccagaattgaatcatgttatttgaccagggacgccagaaaatatggtctgtcgcaccaaacagcgatatcagcggcgtattaactgcagcggcaatatgcgccggtgcggaatcaacgccaataaacagctgcgcatgatcgattaacgcaccaagttccgggaaggtcacctttccggccagcgccgttactggtggcgtctggcatccctgcgcaatttcattgacgcaggccagatcgtctttatctgggccggacgtcagaacgacttcataaccacgagcatgtaaggcatcaatcacagcggaaaacttggcgttgtcccagcatttgaagatttgccgcgccgtaggttggataaccacataattttgtccaacaccagcgtgatcaagttcgcgacgcatacgtttccagcttgcaggcgggtaactcatggttgtctgcttcaccaacgattcaagtcccaatggcgtcagcacggataagttactttccaccacatttccaccctgcaacggcaccaaatgagtgaaactattacgccaaaaagcagactgccgatgatgataatcctgggaaattttcacacgggcatttaataagcgaaccagtatagcaaccatccattgatcggtaagattaacgataaggtcatacttattggcacgtaataccttgatgagatgaaaaaagttggtaattttttctgaggcttttgcttttttattttttatgccgtagagcgcgttaatctctggattttcagacaggatcgggatggtgtcctgataaagcagcacatcgatttttgcgtcagggtaattttttttcagcgaactaatgacgggagtagttaataacatatccccatgaaaacgcatcttaatgagcaaaattcttcgaaatggcttatccacaagtaactctttttgttgagattatccgattaaggtgaagcagaaaaagcacgctaccgccccaggctcaacagctacctgaatactgataccgcactgatattgacgcgctagtgtatcacttctttcgcggcaatccgactcgaatgatttttaagcacattgttgattttcaataaagaaatcaatcaaataaaatcattagcaatcatattcttttactgttgctctgcgattccttcctacacgtactgcagaaatcaataaatcgcataaaaatacaaaaaaagtatagatgttcagcaagaattggcgggtaaattgctatttaagtcaaaaacgggaaaagtaatggtaaagccacagctaaatacatagaatccccagcacatccataagtcagctatttactatgctcgaattgctttacaccgcccttctctaccttattcagccgctgatctggatacggctctgggtgcgcggacgtaaggctccggcctatcgaaaacgctggggtgaacgttacggtttttaccgccatccgctaaaaccaggcggcattatgctgcactccgtctccgtcggtgaaactctggcggcgatcccgttggtgcgcgcactgcgtcatcgttatcctgatttaccgattaccgtaacaaccatgactccaaccggttcggagcgcgtacaatcggctttcgggaaggatgttcagcacgtttatctgccgtatgacctgcccgatgcactcaaccgtttcctgaataaagtcgaccctaaactggtgttgattatggaaaccgaactatggcctaacctgattgcggcgctacataaacgtaaaattccgctggtgatcgctaacgcgcgactctctgcccgctcggccgcaggttatgccaaactgggtaaattcgtccgccgcttgctgcgtcgtattacgctgattgccgcccaaaatgaagaagatggtgcacgttttgtggcgctgggcgcaaaaaataatcaggtgaccgttaccggtagcctgaaattcgatatttctgtaacgccgcagttggctgctaaagccgtgacgctgcgccgccagtgggcaccacaccgcccggtatggattgccaccagcactcatgaaggcgaagagagtgtggtgatcgccgcacatcaggtattgttacagcaattcccgaatttattgctcatcctggtaccccgtcatccagaacgcttcccggatgcgattaaccttgtccgccaggctggactaagctatatcacacgatcttcaggggaagtcccctccaccagcacgcaggttgtggttggcgatacgatgggcgagttgatgttactgtacggcattgccgatctcgcctttgttggcggttcactggttgaacgtggtgggcataatccgctggaagcggccgcacacgctattccggtattgatggggccgcatacgtttaactttaaagacatttgcgcgcggctggagcaggcaagcgggctgattaccgttaccgatgccactacgcttgcaaaagaggtttcctctttactcaccgacgccgattaccgtagtttctatggccgtcatgccgttgaagtgctgtatcaaaaccagggcgcactacagcgtctgcttcaactgctggaaccttacctgccaccgaaaacgcattgaggttgttatgcaaaaacgggcgatttatccgggtactttcgatcccattaccaatggtcatatcgatatcgtgacgcgcgccacgcaaatgttcgatcacgttattctggcgattgccgctagtcccagtaaaaaaccgatgtttaccctggaagagcgtgtggagctggcacagcaggcaaccgcgcatctggggaacgtggaagtggtcgggtttagtgatttgatggcgaacttcgcccgtaatcaacacgctacggtgctgattcgtggcctgcgtgcggtggcggattttgaatatgaaatgcagctggcgcatatgaatcgccacttaatgccggagctggaaagtgtgtttctgatgccgtcgaaagagtggtcgtttatctcttcatcgttggtgaaagaggtggcgcgccatcagggcgatgtcacccatttcctgccggagaatgtccatcaggcgctgatggcgaagttagcgtagcgtttatgccggatggtatgccatccggcgcgcatcaattacttctggcactgccgacaataaaacgttgcccgctgcgcatgtttagtcgccacaatcggcgtaccgcacacccgacacggctcaccttttcgcccgtaaacctgcaattcctgagcgaaatagcccggtttaccatcactttgcagaaaatctttcagcgttgtaccgccctgctcaatcgaacgcagcaacaccgctttaatcacccgagctaacaattcacactccgccagcgacagtgatgacgccagccgatccggatggatccccgccgcaaacagcgattcgctggcatagatattccctacgcctaccaccagcttgttatccatcagccacggtttaatcgccgtttttttcttcgcgcacttctgatgcaggtactcaccgttgaaatcgtcactaagcggctccggtccaagatgggccagcacgttgtgcccttccagctctttggtccatagccaggcaccaaagcggcgcggatcggtgtagcgcagcactttgccgttgctcatcaccaaatccacatggtcatgcttttcagggggaagttcttctggaaggatgcgcaggctgccagacatccccaaatgaatgataatccagccctcaggcagctccagcagcagatatttagcccggcgctgcacgctaagcactggttggtcgcttaaacggtagatctcttctgaaaccggccagcgcaagcgtccgttgcgcaccaccgcatgaagaatggttgcaccaacgagatgcggttctatgccgcgacggctggtttcaacttcgggtaattcaggcatagcatctccaggaatgaacagatgcagtcaatatgggggcaagcagataacaaaaaaccccgccggggcgaggttttttgttacatcaaagcgagaattatttgattttcgcttctttgtagatcacgtgctggcgaacaactggatcgaattttttcagttccagtttttccggcttagtacgtttgttcttcgtagtggtatagaagtgaccagtaccagcagaagaaaccagcttgattttctcacgaatacctttagccatgatttatttcctctaagtacttagtacttttcgccacgggcacgcagttcagccagaactgtatcgatgccttttttatcgattacacgcatacctttagcagatacgcgcagggtgacaaaacgcttctcgctctcaacccagaaacggtgagagtgcaggttcggcaggaaacggcgtttagtcgcgttcagtgcgtgggaacggttgttaccggtcaccggacgcttgccagtaacttggcagactcgggacatgtctattctccaaaaatcaaattagctcgagcttcgtatggggtattggcgcctcgtcaggctttacagcccggtcatcgcagttctatgtgaactctcgattgccaggcccaaatgccaaacccgagattctcaaaggtggcgtagtatacgctgactcagcgatgtgctcaagtcccgaacagacaaagatcccgaaggatcgcgcatagcgggttaaatccagccgcgttcggcaaaagaaacatactctccacgcccaatcacgatatggtcgagcacgcgtaaatccatgaactgacaactctttattatccgttcagtaatgagtttatccgctttactgggttcagcacaacccgaagggtgattatgcgcaaggatcagcgccgaggcgtttatttttatcgcttcgcggataatttcccgaggatggacttcaacatggtttagcgtgccggaaaaaagacggctatgcgttataaccctgtgttgggagtcgagaaagatcaccataaagatctcccgctcctcgcccgtgagctggctttgtaaaaattccctcgtcatctccgggctgagtaaagggctttcttcacgcatccgtacgttgtagtaacgccgcgccagttcggcaatcccctttaactgggcgaatttcgccacgccaattccatgaacgccactaaattgctcatattcagaggttaacaagccataaagagagccgaaattctccagcatctcttttgccagggttaatacatctttaccgcgcgttccggtacgcagaaatagcgccagcagctcgacatccgttaaggcgctaataccaaacttcagcattttttcgcgcggcatcaacagctgtacattgtttttcaccttcacctcctttgtggtgctcgcatcctgtcatagccgttcctttaaatcgacggccagttttcaatcctggaaagcgcctcgcaaagtgaatctcaggtgaaggcacgacaacaaaagtattgtgataaaatcgccaacttctggtgtcacccaacaggaaaaatcatcatgagcctggccggtaaaaaaatcgttctcggcgttagcggcggtattgctgcctataaaacccctgaactggtgcgtcgtttgcgcgatcgcggggccgatgtccgcgtagccatgaccgaagcggcaaaagcctttatcaccccacttagcttgcaggcggtttctggttatcccgtttccgacagtctgctggacccggcagccgaagccgctatgggccatattgagctgggtaaatgggctgatttagtgattctcgcccctgccacggcagatttaattgcccgtgttgctgccggaatggcgaatgacctggtatcgacgatttgtctggctacacctgcgcctgtagccgtgctccccgccatgaaccagcagatgtaccgtgccgctgccacgcagcataatttagaggtgcttgcctcgcgtggtttgctcatctgggggccagacagcggcagtcaggcttgtggtgatatcggcccaggacgaatgctcgatccgttaaccattgtggatatggcggtagcgcatttttcgcccgtcaacgacctgaaacatctgaacattatgattaccgccggtccgacgcgtgaaccgctcgatcccgtgcgttatatctctaatcacagctccggcaagatgggttttgctatcgccgccgccgcagcccgtcgtggcgcgaacgtcacgctggtatcaggtccggtttcactaccgacgccaccgtttgttaaccgtgttgatgtgatgaccgcgctggaaatggaagccgccgtgaatgcttctgtacagcagcaaaatatttttatcggttgcgccgccgtggcggattatcgcgcagctaccgtggccccagaaaaaatcaaaaagcaggccacgcagggtgatgaattaacaataaaaatggttaaaaaccccgatatcgtcgcaggcgttgccgcactaaaagaccatcgaccctacgtcgttggatttgccgccgaaacaaataatgtggaagaatacgcccggcaaaaacgtatccgtaaaaaccttgatctgatctgcgcgaacgatgtttcccagccaactcaaggatttaacagcgacaacaacgcattacaccttttctggcaggacggagataaagtcttaccgcttgagcgcaaagagctccttggccaattattactcgacgagatcgtgacccgttatgatgaaaaaaatcgacgttaagattctggacccgcgcgttgggaaggaatttccgctcccgacttatgccacctctggctctgccggacttgacctgcgtgcctgtctcgacgacgccgtagaactggctccgggtgacactacgctggttccgaccgggctggcgattcatattgccgatccttcactggcggcaatgatgctgccgcgctccggattgggacataagcacggtatcgtgcttggtaacctggtaggattgatcgattctgactatcagggccagttgatgatttccgtgtggaaccgtggtcaggacaacttcaccattcaacctggcgaacgcatcgcccagatgatttttgttccggtagtacaggctgaatttaatctggtggaagatttcgacgccaccgaccgcggtgaaggcggctttggtcactctggtcgtcagtaacacatacgcatccgaataacgtcataacatagccgcaaacatttcgtttgcggtcatagcgtgggtgccgcctggcaagtgcttattttcaggggtattttgtaacatggcagaaaaacaaactgcgaaaaggaaccgtcgcgaggaaatacttcagtctctggcgctgatgctggaatccagcgatggaagccaacgtatcacgacggcaaaactggccgcctctgtcggcgtttccgaagcggcactgtatcgccacttccccagtaagacccgcatgttcgatagcctgattgagtttatcgaagatagcctgattactcgcatcaatctgattctgaaagatgagaaggacaccacagcgcgcctgcgtctgatcgtgttgttgctcctcggttttggtgagcgtaatcctggcctgactcgcatcctcactggtcatgcgctaatgttcgaacaggatcgtctgcaagggcgcatcaaccagctgttcgagcgtattgaagcgcagttgcgtcaggtattgcgtgaaaagagaatgcgtgagggtgaaggttacaccaccgatgaaaccctgctggcaagccagttgctggcattttgtgaaggtatgctgtcacgatttgtccgcagcgagtttaaataccgcccgacggatgattttgacgcccgctggccgctaattgccgcacagttgcagtaagatgacgccggatgacttttcatccggcgagtttcgttaaacgccaaactcttcgcgataggccttaaccgccgccagatgttccgccatttctggcttctcttccaggtaagcaatcaggtctttcagggtgatgatagagatcaccttgcagttgtaatcacgctcaacttcctgaatcgccgaaatttcgccgcgcccgcgttcctgacgatcaagcgaaatcaacacgcctgcaagcgtcgcgccattggcctgaataatttccatcgactcgcgaatcgccgttccggcggtgatcacatcatctaccagcattacgcgtccttgtaacgcgctaccaaccagattaccgccttcaccgtggtcttttgcctctttgcggttaaagcagtacggcaggtcaaggtcatgatgctccgccagcgccacggcggtagtggtggcaatcgggatccctttgtaagcagggccaaacagcagatcgaactcaatgccggaatccaccaatgcttcagcgtaaaaacggcctaacagtgccagatcgcgcccggtattaaacagcccggcgttgaagaaataggggcttttgcgcccggatttcagcgtgaactcgccaaactttaacacctgcttgctaagcgcaaattcaataaactggcgctgatatggtttcatgccttcgctcctcatcttacttttctacagacaaaaaaaaggcgactcatcagtcgccttaaaaatcagtttgccagcgccgccttctgcgtcgctacaatggattcgattccccctcgggccagcgccaacaaggtgagtaactcttcgtgggtgaacggttcgccttctgccgtcccctgcacttcaatgatacgcccgtcttcggtcatcactacgttcatgtcggtctctgcggcagagtcttcaacatattccagatcgcaaaccgcttcaccgttcacaatcccgacagagaccgcggctaccatccctttcattggattagttttcagcttgccgttttccaccagcttctgtagcgcatctgccagcgccacgcaggcacccgtaatcgaagcggtacgcgtgccaccatcagcctgaagcacgtcgcagtccagcgtaatggtgaactcacccagtgctttcaaatctactgccgcgcgaagagcacgggcgatcagacgctggatttccattgtgcgtccaccctgcttacctttcgccgcttcacgcgcgttacgggtatgggtagaacgtggcagcataccgtactctgcggtgatccaaccctggccctgacctttcaggaagcgcggcacgccttcttcaatagaggcggtacacaatactttggtatcgccaaattcgaccagcaccgagccttctgcatgttttgtatagttacgagtcagggtaacgggacgcacctgattattgctacggcctgctggacgcatattgaaatctccggcttgaaacaaatgtggctgcgcattatacggacttccggcggttattcctatcctgacaaggcatcgatggctataatccttccacctctccttttataaacaggaacgtctatgatccgcagtatgaccgcctacgcccggcgtgaaatcaagggtgaatgggggagcgcaacctgggaaatgcgctcggtaaaccagcgttatctggaaacttactttcgtctgccggagcagttccgtagccttgaacctgtcgttcgcgagcgtattcgttctcgcctgacgcgcggtaaagtggaatgtactctgcgctatgagccagatgttagcgcgcaaggtgagctgatcctcaacgaaaaactggctaaacagctggtaactgccgcgaactgggtaaaaatgcagagcgacgaaggagaaatcaacccggttgatattctacgctggccgggcgtgatggcagcccaggagcaagatctcgacgcgattgcagctgaaattctcgcggcgttggatggcaccctggatgactttatcatcgcgcgcgaaaccgaaggtcaggcgctgaaagtgttgattgagcaacgtctggaaggcgtcaccgccgaagtggccaaagtgcgtgcccatatgccggaaatcctgcaatggcagcgtgagcgtctggtagcgaagctggaagatgctcaggtgcaactggaaaacaaccgtctggagcaggagttggttctgctggcacaacgaattgacgttgccgaagaactggaccgcctcgaagcgcatgtcaaagagacctacaacattctgaagaaaaaagaagccgttggtcgtcgtctggactttatgatgcaggagttcaaccgcgagtcgaacactcttgcgtcgaaatctatcaacgccgaagtgacaaactccgccatcgagctgaaagtgttgattgagcagatgcgcgagcagattcagaatatcgagtaagcgacatatctccgtaggccgttgttaattacagcggcgctacgcatatagtttcgtcctcatatttatttactccatactttttctaatgcattttacttatcacaaaatcagaaaaatgcattcttactacagaaaatagcaatttcacataactacaaattatcaatctattctctccttaaaaaatctcaatcgtgacaatgcgcacaaatcgctacccttccagacagatttttagggagagaaccatgctgttacacattttgtatttggttggcattactgccgaagccatgacgggggcgctggcggccggacgacggcgcatggatacatttggcgtaattattattgcgaccgccacggcaattggcggagggtcagtgcgcgatattctgctgggccactatccgctcggctgggtcaaacacccggaatatgtgattatcgtcgctaccgctgcagtactcaccactatagttgctcctgtaatgccttatctgcgcaaagtgtttctggtgctcgatgcgctcggactggtggtcttttctatcatcggcgcacaggttgcactggatatggggcacggcccaattattgccgttgtcgcggcggtaaccaccggcgtgtttggcggcgttttgcgcgatatgttctgtaaacgcatcccactggtattccagaaagagttgtatgcgggtgtctcatttgcctccgccgtgctgtacatcgcgctgcaacactatgtttctaaccatgatgtggtgattatctccaccctggtattcggcttttttgcccgtttactggcgctacgtcttaagctgggattaccggtcttttactacagccacgaaggtcactaaggttcaaaacctgtgatctgctgggcagccagccaactgcccagcttcttgatttgcgcattttccttccattcaataacctgtctggcgcgccccgatccagtccccggcagctgctgccagaactgttccttgctaaataaaagttgcgaccaggaccgttcatcactggcattaagcgccgcccgggttagcggtattcccattgccatcacccagcgagtaaaaggctgctgacgagccagattaaactgatgccataactgcgcacttttacttttcgcgatccccggcgtgttctgtaattgctctggcgttaataaaagccaggaaaagatatgctcaaagcgatgagtctgatgcagggcgcgccagccggcctcaccaatgccatcaagccccagaacctgttttgaccccagccagactaagcgtgaaatgaactgttcctgacaaacatcagaagcaaagtagcaggtcaacgagttaaagcggttttctggtggtgtcggttttgtacgttctgctccgcgccagaccacatcatcaatgcgaggaatcccctgaccggcaaggctgacgaggatctgatcaccaggcgcaatatcccattcctgccagcgcctgacggaaccaatattcacccgctggatttttttatcatccagcatgacaggtgcgagtgacgccaccaccgatattttaccgctcttacccaccgcaaattgaatcgccttcacttcggcaacctgagctacaggttgatatttccaggccaccagccactccgcctggcccggtaaccaatgacgggattcgggttctttcgccgctcgcacaaccacgccatcggtgacgaagggtaattttgctttccaccactcattgcgtacgtgcgcaacctcatcagcatttttaaccgcgcgggtatacgtctgcgttaaagtaaaacctgcggtagccagatcctttaaacgatcggtcattaaatgcggtccatccggccatgcccagacaaaaacagccagtgagtttagcgtatcgctattcccctggcgcatcatcaggccagcaacttttgcgcgggcatttattccccccatttgttgttggatatgccccttacgcttgagaaatatttccccctgaagcgtgctgttggctaaaggcccgctaacggtttgcggcacagcggaaattaagcgaactttctgcgtccagtcctcgcctttcaggccattaccgcgactgattgctttgttcagtttcccgtcccgataaaccagggttaccgcaacgccatcaacttttggctgcacccaaagatcgctacgttcgcgcatccacagacttaatgcgtttttatccgccattttgcgtacacccgtatgggcaaccggatgcataaccgcaccgtttaaaggcggcatcatcacatcgcgagtctcgttcccaaaacagcgttgccactgcgtgagacgggcgcttaactgatcgtaaacaccgtcttccacctcacttttcccttccttccagtagtcatcgtcccactgttttatttgctgttgcaggcgggaaatttcttcctgtgctctggctggcgaccaggccggacagaccgcccacgccgatgattgccagcacaagatacttattaatatcgccatccatactttcatcatcacctccgctgtagatagtcaggcagatatacaacgtggtgaaagcaaagccgagtggcaaaaacggagtctgcgaggacgcttcctgagaatcgtctttattgcagtgaatcacaggcaaatgcggaagcagctacgcaaaatgcaacaactttgcgcaaaaagtgtgagcaagggctacgtcacatggccgcgccgtgtataataagctcgtatgtaggctttatttcgctaatcacatacgaaagatactcatggctcaaggcacgctttatattgtttctgcccccagtggcgcgggtaaatccagcctgattcaggctttattaaaaacccaaccgttgtatgacacccaggtttctgtttcacacaccacacgccaaccgcgtcctggtgaagtccacggtgaacattatttctttgttaatcatgatgaatttaaagaaatgattagtagagatgcgttcctcgaacacgcagaagtttttggtaattactatggcacttcgcgtgaggccattgagcaagtactggcgaccggtgtcgatgtttttctcgatatcgactggcagggtgcgcagcaaattcgccagaagatgccgcacgcgcggagtatctttattttaccgccgtctaaaatcgaactggaccgccgtctacgcggtcgcggtcaggacagcgaagaggtcattgcaaagcgtatggcgcaagctgttgcagaaatgagccattacgccgaatatgattacctgattgtgaatgatgacttcgataccgcgttgaccgatttgaagaccattattcgcgccgaacgtctgcgcatgagccgccaaaagcagcgtcatgacgctttaatcagcaaattgttggcagactgaacctgatttcagtatcatgcccagtcatttcttcacctgtggagctttttaagtatggcacgcgtaactgttcaggacgctgtagagaaaattggtaaccgttttgacctagtactggtcgccgcgcgtcgcgctcgtcagatgcaggtaggcggaaaggatccgctggtaccggaagaaaacgataaaaccactgtaatcgcgctgcgcgaaatcgaagaaggtctgatcaacaaccagatcctcgacgttcgcgaacgccaggaacagcaagagcaggaagccgctgaattacaagccgttaccgctattgctgaaggtcgtcgttaatcacaaagcgggtcgcccttgtatctgtttgaaagcctgaatcagctgattcaaaactacctgccggaagaccaaatcaagcgtctgcggcaggcgtatctcgttgcacgtgatgctcacgaggggcaaacacgttcaagcggtgaaccctatatcacgcacccggtggcggttgcctgcattctggccgagatgaaactcgactatgaaacgctgatggcggcgctgctgcatgatgtgattgaagatacacccgccacctaccaggacatggaacagctttttggtaaaagcgtcgccgagctggtagagggggtgtcgaaacttgataaactcaagttccgcgataagaaagaggcgcaggccgaaaactttcgcaagatgattatggcgatggtgcaggatatccgcgtcattctcatcaaacttgccgaccgtacccacaacatgcgcacgctgggctcacttcgcccggacaaacgtcgccgcatcgcccgtgaaactctcgaaatatacagcccgctggcgcaccgtttaggtatccaccacattaaaaccgaactcgaggagctgggttttgaggcgctgtatcccaaccgttatcgcgtaatcaaagaagtggtgaaagccgcgcgcggcaaccgtaaagagatgatccagaagattctttctgaaatcgaagggcgtttgcaggaagcgggaataccgtgccgcgtcagtggtcgcgaaaagcatctttattcgatttactgcaaaatggtgctcaaagagcagcgttttcactcaatcatggacatctacgctttccgcgtgatcgtcaatgattctgacacctgttatcgcgtgctgggccagatgcacagcctgtacaagccgcgtccgggccgcgtgaaagactatatcgccattccaaaagcgaacggctatcagtctttgcacacctcgatgattggcccgcacggcgtgccggttgaggtccagatccgtaccgaagatatggatcagatggcggagatgggtgttgccgcgcactgggcttataaagagcacggcgaaaccagcactaccgcgcaaatacgcgcccagcgctggatgcaaagcctgctggagctgcaacagagtgccggtagctcgtttgaatttatcgagagcgttaaatccgatctcttcccggatgagatttacgttttcacaccagaagggcgcattgtcgaactgcctgccggtgcaacgcccgtcgacttcgcttatgcggtgcataccgatatcggccatgcctgcgtgggcgcacgcgtcgaccgccagccttacccgctgtcgcagccgcttactagcggtcaaaccgttgaaatcattaccgcaccgggtgctcgcccgaatgccgcgtggctgaactttgtcgtcagctcgaaagcgcgcgccaaaattcgtcagttgctgaaaaacctcaagcgtgatgattctgtaagcctgggccgtcgtctgctcaaccatgcgttgggtggtagccgtaagctcaatgaaatcccgcaggaaaatattcagcgcgagctggagcgcatgaagctggcaacgcttgacgatctgctggcagaaataggccttggtaacgcaatgagcgtggtggtcgcgaaaaatctgcaacatggggacgcctccattccaccggcaacccaaagtcacggacatctgcccattaaaggtgccgatggcgtgctgatcacctttgcgaaatgctgccgcccaattcctggcgacccgattatcgcccacgtcagccccggtaaaggtctggtgatccaccatgaatcctgccgtaacatccgtggctaccagaaagagccagagaagtttatggctgttgaatgggataaagagacggcgcaggaattcatcaccgaaatcaaggtggagatgttcaatcatcagggcgcgctggcaaacctgacggcggcaattaacaccacgacctcgaatattcaaagtttgaatacggaagagaaagatggtcgcgtctatagcgcctttattcgtctgaccgcccgtgaccgtgtgcatctggcgaatatcatgcgcaaaatccgcgtgatgccagacgtgattaaagtcacccgaaaccgaaattaatgttttatgaacccaacacgttatgcacgcatctgcgaaatgctcgccaggcggcagcctgatctgaccgtctgcatggagcaggtccacaaacctcataacgtttctgcgattattcgtaccgcagatgccgttggcgtacatgaagttcatgctgtctggcctggcagccggatgcgcaccatggcttcggcagctgcgggtagtaacagctgggtacaggtgaaaacgcaccgcaccattggcgatgccgtcgctcatctgaaaggccagggcatgcagattctggcaacccatctttctgataacgctgttgatttccgcgaaattgattacactcgcccgacctgtattttgatgggacaggagaaaacgggcatcacgcaggaagcgttggccctggcggatcaggatatcatcattccgatgatcggcatggtgcagtcgctgaatgtttccgttgcctcagccctcattctttacgaagcccagcgccagcggcaaaatgcgggcatgtacctgcgtgaaaacagcatgttgccggaagccgagcaacaacgcctgctgtttgaaggcggctatccggtgctggcgaaagtcgcaaaacgcaaaggtctgccctacccccacgttaatcagcaaggcgagattgaagccgatgctgactggtggtccaccatgcaggccgcagggtaagcgcgatgaaaggtcgcctgttagatgctgtcccgctcagttccctaacgggcgttggcgcagcgcttagtaacaagctggcgaaaatcaacctgcataccgtacaggatttgctcttacaccttcctctgcgctacgaagatcgcacacatctctaccccatcggtgaactactgccgggtgtttatgccacggtggaaggcgaagtgctgaactgcaatatctccttcggcggtcggcggatgatgacctgccagatcagcgacggttccggcattctcactatgcgctttttcaacttcaatgcggcaatgaaaaatagcctggcgacaggccgccgcgtgctggcctatggcgaagcaaagcgcggcaaatatggtgcggagatgatccacccggaataccgcgtacagggcgatctcagcacgccagagttacaggaaacgctcacaccggtttatccaactacggaaggcgtaaagcaggctacgctgcgtaaattaaccgaccaggcgctggatctgctcgacacatgcgccattgaagaactcctgccgccggaactgtcacaaggaatgatgacgctaccggaagcgttgcgcactttgcaccgcccgccgccgacgctacagcttagcgatctcgaaaccgggcagcatccggcacaacgccggctgattctcgaagagttgctggcgcacaacctcagcatgttggcgttacgtgccggtgcacaacgttttcatgctcagccgctgagcgccaatgacgcgctgaaaaataaactcctcgccgccttaccgttcaagccaacgggcgcacaggcacgcgtagtggcggagatcgagcgcgatatggcgctggatgtgccgatgatgcgtctggtgcagggcgatgtaggttccggtaaaacgctggtcgccgccctcgccgcgttgcgtgcggttgcccacggcaaacaggtggcactgatggcaccaaccgaattactcgccgagcagcacgccaataacttccgtaactggtttgcaccgctcggtatcgaagtaggctggctcgccggaaaacagaaaggtaaagcacgactggctcagcaagaagccatcgccagcggtcaggtgcagatgattgttggtacgcacgccattttccaggaacaggtgcagtttaacggcctggcgctggtgattatcgacgaacagcatcgttttggcgtacatcagcgtctggcgttatgggagaaaggccagcagcagggcttccatccgcatcagttgatcatgaccgccacgcccatcccccgcacgctggcgatgactgcgtatgccgatctcgatacctcggtgatagatgagctgccaccaggccgcacgccagtgactacggtcgctattcctgatacccgccgtatcgatatcattgaccgcgtgcgccacgcctgtatgactgaagggcgtcaggcgtactgggtttgtacgttgattgaagagtcggaattactggaagcgcaggcggcggaagcgacctgggaagagttgaaactggcgctaccagagttgaatgttggcctggttcacggacggatgaaacccgccgagaaacaggcggtgatgacatcgtttaaacaaggcgagctacacctgctggttgccactactgtcattgaagtcggtgttgatgtacccaatgccagtctgatgattatcgaaaacccggagcgtctgggtctggcgcagttacaccagttacgtggccgcgtgggtcgtggcgcggtggcctctcactgcgtgctgctctacaaaacgccgctctccaaaaccgcgcaaatccgcctgcaggtactacgcgacagcaacgatggttttgtgattgcacagaaagatctggagattcgcggccctggcgaattgttaggtacacgtcagacggggaatgctgaatttaaagtggcgaatttactgcgcgatcaggcgatgatcccggaagttcagcgcctggcgcgacatattcacgaacgttacccacaacaggcaaaagccctgatagaacgctggatgccagaaacagaacgctactcgaatgcgtaaaaggcggcggtgagaagaccgccgcttcatcggttaacccgtaaaaatcggcaacatcaaatacagcttaatcaccagcgcattgacgatatcgataaagaacgcaccgaccatcggcacgaccaggaacgccatgtgcgacgggccaaagcgttcagtgatcgcctgcatgttggcgattgccgttggcgttgcaccgaggccaaaaccacagtgacccgcagccagcactgccgcatcgtagtttttgcccatcatgcgccaggtaacgaagatggcatacaacgccatgaagatggtctgtaccaccagaatcgccagcatcggcaacgccagcgaagccagctcccacagtttcagccccatcagcgccatcgccaggaacaacgacaggcttacgttacccagcacggataccgctcgctcaaagacgcggtaaaagcccatcattgacagaccgttgctcagaatcacgccaacaaatagtacacagacgaaggtcggtagttcaaaagcagtaccagccaaaagttgcgcaacaattttccccaccgtcaggcagatagcaatcagcgcgatagtttcaatcagcaccagcgaggtgatcatgcggcccacatccggcttttcgaacgcagtcggaacttcctggtcatccggaataccgttcggtgtggtggagtgtttcaccagatagcgcgccaccggaccgccaatcaagccgcccagcaccaaaccgaacgttgcacaggccatcgccacttctgtcgcgttggtgaagccataacgttcaatgaacaatttactccatgcagcacccgtaccgtgaccgccggaaagcgtaatagaaccggccagcagccccatcagcggatcaagccctaacaggctagccataccaatgccaatggcattttgcatcaccaacaggccaacaaccacaatcaggaaaacccccaccacacgcccaccagctcgcagactggcaaggttggcgttcaggccaatggtggcgaagaaagccagcatcaacggatcgcgcagggacatatcaaagttgacttcccagcccatgctttttttcagtatcagcagcgccagcgccactaataaaccacccgcaacaggttccggtatggtgtattttttcaaaaaggagacggaatggaccaacttgcgcccgagcagcaacgtcagcgttgcggcaacaagcgttgctaaagtatcgagatgaaacatagttactcctttgtgtccgcatcactctttcatactcgtcatacttcatcgcgcatttgcagtaaggcgaaatatgacgagtatcgagtcatgctttcctggttcgaattcttagctgaaactagaaaaatggcatggattttaagcagaaaacaactaaaagttatataaaaaagtacatttatctcatttaaatatttagatgaggatgtggcaaacgtttgcttttctctttcggtcagctaaaatgcccgctttgctaccacgggattgttttcgatgtctgtttccaccctcgagtcagaaaatgcgcaaccggttgcgcagactcaaaacagcgaactgatttaccgtcttgaagatcgtccgccgcttcctcaaaccctgtttgccgcctgtcagcatttgctggcgatgttcgttgcggtgatcacgccagcgctattaatctgccaggcgctgggtttaccggcacaagacacgcaacacattattagtatgtcgctgtttgcctccggtgtggcatcgattattcaaattaaggcctggggtccggttggctccgggttgttgtctattcagggcaccagcttcaactttgttgctccgctgattatgggcggcacagcgctgaagaccggtggtgctgatgttcctaccatgatggcagctttgttcggcacgttgatgctggcaagttgtaccgagatggtgatctcccgcgttctgcatctggcgcgccgcattattacgccactggtttctggcgttgtggtgatgattatcggcctgtcgctaattcaggttggactgacctccattggcggcggttacgcagccatgagcgataacaccttcggcgcaccgaaaaatctgctgctggcaggcgtggtcttagccttaattatcctgcttaaccgtcaacgtaacccttacttacgcgtggcctcactggtcattgcgatggcggccggatatgcgctggcgtggtttatgggcatgttgccagaaagcaacgaaccgaggacacaagaactgattatggtgccaacgccgctctattacggtcttggcattgaatggagtctgctgctgccgctgatgctggtctttatgatcacttcgctggaaaccattggcgatatcacggcgacctctgacgtttccgaacagccggtttccggtccgctgtacatgaaacgcctgaaaggcggcgtgctggcaaacggcctgaactcgtttgtctcggcggtatttaataccttcccgaactcctgcttcgggcagaacaacggggtgatccagttaaccggtgttgccagccgctatgtcggttttgtcgtcgcgctgatgttgatcgtgctgggtctgttcccggcagtgagcggttttgtacaacacattccagaaccggttctgggcggcgcaacgcttgtaatgtttggcaccatcgccgcctccggtgtgcgtatcgtttctcgtgagccgctgaaccgccgggcaattctgattatcgcgctgtcgctggcggtcggtctgggcgtgtctcagcagccgctgattttgcagtttgcccctgaatggctgaaaaacctactctcctccgggattgccgcgggcggtattactgccatcgtgctgaatctgattttcccaccagaaaaacagtaattcactggcggcggtaagataattaccgccgcagtctcacctctttcaccattcccgccttgaggattgcgcgtaaatcgtgcataactcccttatgtgcatttcacgggatggaagaccatgaaatttattgggaagctgcttctctacattctcatcgctctgttagtggtgatcgctggcctctattttcttctgcaaacccgctggggagcagaacatatcagcgcatgggtttccgagaatagcgactatcatctggccttcggggcgatggatcaccgtttttccgcgccatctcatatcgtgctggagaacgtcacgtttggccgtgatggccagcccgcgaccctggtggcaaaaagtgtcgacattgcgctaagcagtcggcaactgaccgaaccacgccatgtcgataccatcctgctggaaaacgggacgctgaatctcaccgaccagaccgcgccgctaccgttcaaagccgatcgtctgcaactgcgtgatatggcgtttaatagcccgaatagcgaatggaaactgagcgcgcagcgggtaaatggcggcgtggttccgtggtcaccagaagccggtaaagtgctgggtacgaaggcgcagattcagtttagtgccggatcgctttcgctcaatgatgttcctgccaccaatgtactgattgaaggcagtattgataacgatcgcgttacgctgactaacctgggtgccgacatcgcccgcgggacattaaccggaaacgcgcagcgtaacgctgacggcagctggcaagtggaaaacctgcgcatggcggatatccgtctacaaagcgaaaaatcgctaaccgacttctttgcgccattacgctctgtcccgtcgttgcagattggtcgcctggaagtcatcgacgctcgtttgcaaggtccggactgggcggtgaccgacctcgatctcagcttgcgcaacatgaccttcagtaaagatgactggcagacacaggaaggcaaactgtcgatgaacgccagcgagtttatttatggctcgctgcatttatttgatccgattataaacgcggaattttccccgcagggcgtagcactgcgccagttcaccagccgctgggaagggggtatggtcagaacgtcaggaaactggcaacgcgacgggaaaacgctgatcctcgatgatgcggcaattgccggactggaatataccttgccaaaaaactggcaacagttgtggatggaaacgacacccagttggttaaacagcctgcaactgaagagatttagcgccagccgcaatctgatcattgatatcgaccctgacttcccgtggcagctcaccgcgctcgatggttacggtgccaatctgacgctggttaccgatcataaatggggcgtctggagtggctcggcgaatctgaatgccgccgccgcaacgtttaatcgtgttgatgtccgtcgtccgtcgctggcgctaactgccaacagcagcacggtgaatatcagcgaactgagtgcatttactgaaaaaggcattctggaagccaccgccagtgtttcacaaacgccacaacgtcagacccatatcagcctgaatggacgcggtgtgccggtgaatattttgcaacattggggatggcctgaattaccgttgactggcgacggcaatattcagcttaccgccagtggcgatattcaggtcaatgtcccgctgaaacctacggttagcgggcaattgcatgccgtgaatgccgcaaagcagcaagtgactcaaaccatgaatgcgggcgtagtttccagtggtgaagttacgtcgacggagccggtgcagtaaaaataaggacgctagcggatatcagcgctagcgttccccgttattagcgcaaaattccatactcactgcacaataaccatttcaccggttcatcttcttctatcgccggaaaacgtcctcccggctcaagaaaataattatcgtgttggtcatcatttaccatcgagatttcccagccgagaacaaacgctttttccgcccagaagcgatgatacagacgcggcggcaggcaaatgccctgccccggctttagcaccagcgtttcaccaggtttcatggtacgccgctgaccatcaacactcacggtaatgactcgttgatcatcacagagattgacttcgttggcccaggccaactgcatgcataagtctccaccgccccgattgaggatatcttccattttgtgggtgtgaaaatgccagggagtctgctgatcttgttggatctgcaacattttctcagcatacggttttggatatgccgccgaccccagcgcgccgttgcgcatcgttagcagtgttagtcccgtttggttgaaatcaccacgaccaaaatcggtgatatcccaaccgagctgtaagtcgaccacttcttgccagttatcccgttcccgctgcagccagtcatccaccgtaaaataggcgaactctggcaaacaaacgcggaaggtctgcgcaatggcatgtgctttatcaataacataattaatttgtgaacgtttcattggcttctccgttgcgcatagcaagccaggcagcgccacgcattccgctactgtcgccgtgctgtgcttttacaatgggagtggtgaattgatcggtgaaaaccagtggagcgacttctgcgttcagatcggtgataagcagttccacattcgaaagcccgccgccgatcacaatcacgccagggtcaacaacattaacgatggttgccagcgtgcgggcaagctgttggcgaaaacgtgccacctgctgcatggcacaagcatcaccacgttgtgccagggtgacaatcgccgcagaagtgagcaagttacccgtcatctgttgatagcgttcactaaaaccgctgccggaaacaaacgactccacgcagttgtgtttgccgcaatagcaactgactgatggaccatcttcctgctccgtatagcctggcaacgtgatatgaccgcattcggcagcatttccccaggcccctataaacggtcgttgcttgatggcaatgccaccgccgcagcccgtaccaagcgtaataccaaataccacgtcataatcttgcccggcaccgtcgcaagcttctgatagcgcgaaacagttaccatcattggctatcaccaccggttgcccaagcaattgctgcaaatcagcctgtaacgcatgaccgttaatcacctgaatattcgcgtttttaatcaggccagtgagtggcgagatactgccgggtaaggcgatccctgtcagcatcggtcgttgaacgtcccgcctaatctgctcgataagcgccacaacgcatgagacaaattgttgatatgttgacttttgcgtcgggcagcggtaacggcgaatctcccagccatgcgcatccatgacaacggcggcgattttggtcccaccaatatccaaccccagatagtgcatatctcgttccttgttgcgtaaaaggcgggtcaccccgcccttctggcttagtacagtgatgctttaccgaacgaaccgaacagtttcattttgtggcgaatgacttcccgcgccgcgttaatcgcatccggatagatgacgttcgggtcccaccagctctctttagcgagaatttcacgcactttctggaaataggcgtatttcatatcgctggagatattgattttgccgacgccgagcgtaactgattcagcaatctccgcgtccgggtttgccgaaccaccgtgtagcaccagcggaatatcaatacgtccggcaatgtcgcgcaaaatgttcatttgcagcttcggctgcatcccttttggatagatgccatgcgctgtaccaatcgccacagccagtgtgtcggcacctgtacgagcaataaaatcggcggcctgcgccggatctgtgtaggtcacttgtgaaacaccaccttctaccgacgttcctgtttgtccgatggtttccagttcaccctcaaccgacacgccaaccgcgtgagcgaggcgaaccacttctgcggtcagcgccacgttttcttcatacggcagcagcgaaccgtcgatcattactgaggtaaatccgcagcgaatcgcacgcaaaacatgctctacagaggcaccatgatcgaggtgcagtacaaacgggaccggactacgctgggtaatttcgcgaacgtgagcgaaaaaggcatcgcccacaaaatcatgttcgctgggatggatggcaataatcgccggagtatttgtcgcttctgcttcatccacgactgcgcgaaggaaacagttatccgccacattaaatgcgccaatggcaaagccgtgctggcgggtaggttgcagtaattctttcatcgaaactaacatgttaaatctccagtttcagcgtgtagtccgccctgccggtgcgttattgcactggcataaaggccatgacagaaaatgaatcaggctttgccgatagagccgctcgcctgtaaatacggtgtaatcgcttcttcgaaggccagttccatagctttcagcgcgtccaccagttcaatggatatatcgtgacagagggtatgcaggagcgcagatttcccccgttcaaaaatggccgcccccacgttgatttttgctacccccagagtcgtacagagctggagctgatcgaacggcgtaccgctaccgccatgtaatgccagaggcacgctcgagcagtggaaaatctccgccagacgctgaaaatcaatagcaggtacaacaccaggcgcgtacatgccgtgcgccgtgcctaccgaaacggccagtagatcaatgcctgtctgcacgataaacggttccacatcagtgggttgcgtcatcatgtctgcattggcggcctggtcataacgcggcgcatctgccagatggcccagttcaccttccacgcagagctgcgcgctggcggcgagttccaccaccgccctggtctggcgcacgttttcctccaggggaaaagcagaagcatcaatcattaatccgctgaaaccagcacgaaacgcctgacgaatacagtccggatttttgccatgatcaagcgccagagcgaccggtactgaggcagattccgcgagcgttttaaccactgccgccgcgacgggggcaggaaaatgcgccagatgcccctgatagagattgagaatgatcggagcgcgattcttctccgccacgcggatagctgcgtgagcactttccagattcatacagttgatcgccagcaaggcgtaatgttcatgccaggctttcatcaccatacttttcatatcggcaaacatagggcctccggttattcgagggtgaaagtgatctcttcatctttcagcttttgatcgctcagttcgtcaaactcttcgtcgcgttccgttaccggtttcttccagagtgaaagcatcacgccacaaatcaccgtgcctatacccagcgccaggcaaaacagcagaggatgggtgaacagaggcacaacaaacatgccgccatgcggaaccggactctccacgccccacaccatgattaagccgcccgcgaccgccgatgccaccacacaagatcccactactcgcagcaggtcacgcgcggcgatcggaatgactccttcagtgatcatgcagatccccatcggaaacgcggctttcagcgcctcgcgctccgcacgggtgtatttatggcgtgtcagtaagaacgaaagtgtgatgccaaacggagggatgattgagccgacaaatttcacggcttctggtccgtagacgccactgaccagcaaaccatcggaaaacagcgacatggttttgttgaccggaccaccgaaatcgaaggttgccatcgcgccaagtatggcccccatcaggaagcgcgatccgccctgcatcgactcgagcaaatgaatcagtgcttcttgtaaccaggcgatgggtttaccaatcagcgtcatcattaacagcccaccgataatggtgcttaataccggcaacaccatgattggcatgagtccttgcatcgactgcggcaggcggatatagcgtttaagtagcaaaatggtgtagcccaccaggaaaccacccaacataccgccaataaatccggtatggatttgcccgcagagaaagccgacaatcaggcctggggcaaatccgggacgatcggcaatagaataggcaattgccgcgctaatcagcggcacaatcagccccattccccagccgccaatctgattaagcatccacgggattgttcctgttttttcaccaacatctgtaccgccaagaacttgccccaacgcaatacatatcccggcggccacaataaggggtatcatccacgagatgccggttaataaatgttttttaatttcctgtgaaaccggaattttattttctttcatattaagatccctccagtataaggatcatttgtttcccagtgatttttcgaccttttcaagaaattgaacgggcgatttaatgacgatctctgtctttactcgcacaatacgtttattggtgaagcgttcttctccttttattttcacatctacagcaagaatcacgacgtcagcagcagagatatctgccgcctgtaattcattttctgtaccaatggttccctgggtttcaactttaatggtatggcccagagcttttgctcctttgattaacttttcacgagcaatataggtatgagcaatacccgccgtacaggcggcaacacagacaatattcatgacatacttcctgttatttagcagacatcggattgtgcatactgactaaagagatcaatgattttttgcggactcgtctcaactaacaattgttctatgatgtcatcatccgccagcgcgcccgcgacctgggaaagtaaacggatatgggtggtattttgatcttcaagacgtaccgcaaataaaataatacagcgcacgctactgccatccagcgtttcccagggaatatcctggcgggtacggccaattgccagcgtagtattaattaccgcagaagatttaccatgcgggatcgcaatatgattttcaaaaccagtcgagccttccgcttcgcgctgccagacatctttaataaaggtttcccgacaatcgatcgcaccatcttttttgagaagattagttaattcttcaatcgcctccgctttattcgttgcttgcatatctaaaataacgcgattcgtattcaggatttttgttatgtccattcgtcatacctcataaaattctgacattaaatttcaacgacccgagacgtcgcatgatgtaatttttccgtaatcaccatttcagtgacccgcttaatatcggcatcattaaaaaaagcggtaacataagcgaccggcatagtgactgtaggcaaattaatggtcgaaataatcagttcgatattgtcaggcaaaacctgtgataaattcgctgctgaaataacatcaacaatcgtccattcaggaaatgctcgcagaatacggcttttcagtagatgcgaagttccgattccggttgaacagaccagtaatacacgtttacgggcaatttgccgctccatcgcagcctgaaaatgaacggtcaggtaacccacttcatcctcgctcactgcattctcaccccaggttttaaatacctgattcaccacatattgcgtcaaccgccagacatccgctaattctgctttaatatcttccagcaatggattacggatatgaatgcgataatttagacggttaatcagcggcttaatatgcaccaataagccatcatataatgcgctgtcttcactaaaatcgcagtccacgatgtcactgaataccgtaattaaacgccaggtaatcagacgcgcttcattgctggcctgcatatgtgaaataatgctaacatctttttgtccatcaatcgccacacctgatgaaatgatatattgataaataaaccagacttcatcatcgggcaatgtatgtgcaattcgttgttctatcttatgaatcatctgactggcaacattaaagatattttcatcatattgcctggtttgatcttcttctcttgataacgcattcccgtgcgtgttgcgatacatcataataaggatgtgagtaaaaatgttaacgtaataaggttctcccaaagaccaacttaattcattttccatatccagtaacaatgactggacaaataacacctcttcttctccaaaataatggactaatgctttatagcttccgggatccagacgtgaatacacgacaccttgcggctcattatggttaataatgccgttaatcagtaatgccattgcctgtcggacttgcccttcactaccttcaatatgcgtaccacttggactgcggatcaacgataaccccaacggcgcaagccaggactcaattactctcaggtcattaacaatagaggctccgctgataaagtagcgttctgacaatttactgatcgacgtttcattcggtgtttcacttaataactgcgacgctattttaacgcgcctggcattattcattacaccatcaatctcttcacattctgccaccaacaaatgatcaagatgcagcaaatcagcaatattctccgcacttaacatcacacccgcgccagcacgcttctcaacatttattctccattgtcccagccattgctcaagtaaacgtaaatcacgttgaatggttttttccgaaacatttaaatagccggcaatcgtaacaatagtcgtatattcccttcgaggtaaaaggaatcgtaataatctgttttgtcgcgaggtaatcatttgcattttttacccttatcacagattaagaagccccatatggaagagcttcagttgccatctctgagggtaaatataaagcagaataatttcacaacaatactaaaatctgtccgtaatccggacagtgataaaacaaagcaaggcggttaagggatatttttcagcacagatcacattttcgtgatgaataatcgtgatcatgctcgcaaatacgatggaagaaatatttattaccagatgtgagattatttaccggatacgacacaaaaccattcgtatccggcattcttcaatagattacaacgtaattgtcagcgcattcccttgaggagtcaccaccagtccctgctcactttcagcctgcgaaccgccttgcagaccatttactttcacaacattgcgcaagcacagtgtccagttcttcgcctcgcccgtaccagtcacagtaatcgtgttgccagtacgtgctgcttttaaagtaaagatcaccgaaccgtcagcagtgggcacttcacagacagcctcatgcccgtcttgcagattaaagaggtggaatgccgtaccttcgtgccacgcgtaatcgggacgttgatcgttgttgcccagcgccagtagggtgctatcacgcacataaacgggcagactcaggaagctgtgctgctgtttatgccagcgactaccgtcgagttcatcgttgtgccacaggtgtgtccagcgaccttccggcaggtagaactgcacatcgcccgcttcagtgaacacaggcgcaaccatcacgttgtcgcctaacatatattgacggtcaaggtaatcacaagccggatcgtccgggaactccatcatcatggcccgcatcatcggcgtaccccgggcgtttgcacgtgcagcttcacgatacagatacggcatcatgcggcatttcagttgcgtgaagaagcgcaccacatcacaggactcatcatcgtaggcccacggcacacgataagatttgctgccatgtaaacggctatggctggaaagcaaaccaaacgcgcaccagcgtttgtaaacgtgcgccggagcggtattttcaaagccgccgatatcgtggctccagaagccaaaacctgaaaggccaatagacaaaccaccgcgcaggctttccgccattgattcgtagttagcgtaacagtcgccaccccagtgtaccggaaatttctgcgcaccaacggaggccgagcgggcaaacaagacggcttcttcctcaccaacggtgtccttgagcacgttccacaccagttcgttgtagatgtacgcataatggttatgcattttctgcggatcggaaccatcaaaccactgaacatcggttggaatacgttcgccaaagtcggtcttaaagcaatcaacgcccatcgcgaccagacctttcagtttgtcggcgtaccatttgcaggcatccggattggtaaagtcataaatcgccagacctggctgccatttatcccactgccacagcgaaccgtccgggcgtttgaataaataacctttctcttgtaactctttaaagacgggggatttttgcccaatataggggttaatccagacgcagattttcagccctttcgctttcagacggcggatcatcccttccgggtccggaaaagtcagcgggtcccactcaaaatcgcaccactggaaggctttcatccagaaacagtcaaagtggaaaacatgcagcggcagattgcgttccgccataccatcgataaagctgtttaccgtcgcttcgtcgtagttggtggtaaatgaagtggttagccacagaccgaaggaccacgcgggcggcagcgccggacggccagtaaaacgggtataacgatcaagtaccgctttcggcgtcgggccgtcgataacaaagtattcgagatattcactctcaacgctgaactgtactttggagactttctccgatcccacttcaaaagagacgcattgaggatgattgaccagtaccccataaccacggttagtcatataaaacgggatatttttatacgcctgttcagtacttgtgccgccgtcccggttccaggtctctaccgtctgaccattgcgcaccagggcagtaaagcgctctcccagaccgtaaactgtttcgccaacgccaagatccagccgctcaaacatataatttcgttgattattcgtgtcctgcacgtagccattatttttcacctgactaccggtaatacgttcgccgttgcgcagaaaatccagtgaccagaactcacctttgctgacacgcgcacttaagttgccacttttaaactcagcgtaacgttctgtgttttcgatagtgaccttcacgtcctgcaaaatattgagcgggtaatgaggaccgttattcagcgccccctgaaaatgctcaatccgtacaccgacaataccttcctgtggagagaaaaagcgcagcgtaaataaaggcgtatcaagctgccaggtacgttcacgcacatcacgaggggcagcatagaccaccatttcattaccctgctgttcaacctcgaatacctgaagcgggtgaatcaaattgaggtcaggttgaatcaaccagtttccgtcgctaattttcattgccgttccttagttctgcacttcttgagaggtgaattgttgctggcaacggcgtttgccctgcgccagctgttccataacggttttcagattgtgcgtcgtgagcgagtagtagcgtttagcgataatcgcgctcagcaagtaacagatcgccggaacaatcgtgaatagcgcgataatgatgctaattgtggcgctgttctgcgctttttctgccgcatcatatccgccataagccagcatccagccgataagggcaccaccgaaggccaaccccagtttgagcacaaacagcgtgccagcaaaactgatcccggtcaggcgtttaccattacaccactcgccgtagtcgacggtatcggacatcattacccactggataggtgtcaccagttgatgcaacacaccaatcacgaagatgaagacaaacatagtgatgctggcctgcatgggaacaaagaacatcgcgaggctaatcactgccagcagggcgttcgtccaccagaagatagtgactttacatttccagtcggtcagcggttttgccagtgcggaaccaatcaggttacccacgcaataagtggtgagaaaagcgacaaacacttccggcgtacccaaaatccatgtgacgtaatacatcatcgctccaccgcgtacgcacaccgccaggatattgaaaattgtcaggaaaccgacaatacgccactggtcgttttgccagatatcacgtaaatcatcccgcatagacgtcgttgtaggtggtgcttcaacgcgttctttagtggtgaagaaacagaatgccagcatcataaatgccaccacggaaaggaccgcgataccgccctggaaaccgagtggtttattatcaccaccaattaaattaaccagtggcatcatcagaacagtagagagcatgcctcccgcggtcgccagcacaaaacgccaggattgcagcgagatacgctgagtcgggtcattggtgattacaccacccaatgcgcagtaagggatattgacgatggtataaagtaaggtaagtagagtgtaagtaattgctgcataaatcatttttccgttcatactgagatctggcgtgctataggccagtacacagacgatcccgaatggcagtgcgccaaacagtatccacggacgaaatttaccccagcgagagcgcgttcgatcggccaacaaccccatgcaaggatcggaaatcgcatccagtgcacgagcgaccaaaaacatggttccgacaaatccggcaggaatgccaaaaatatcggtataaaagaacatcatatataacattacgttatcgaaaataatgtggctggcggcgtctcccatgccataaccaattttctctttaacggacaacacttcactcttcatctgcttttccttgatgctataggggtgctgagaccgataacgcattttgtaaaccatccctgcgagagcgaatattccgatatctggttattaatttatgattcttgttttatgtgatcgtggtagcgttaatttcgctcatatatcattgtaaaatatgagttttatatgaactataatgttttcgtgataatacgctgcgtgtattaggcggaaaaaactgatctgggggatgtagaaactcaaggaagtagctataatgcgccccgcctccatgtagcaatcgaggcgcggaagatcgtcgtctccggtgaggcggctggacttcaaatccagttggggccgccagcggtcccgggcaggttcgactcctgtgatcttccgccaaaatgcctctcctgaactctcccgacgtcaacaacactccttcggaggcgacatgtcagacaaagacttaacccagcccccagcaggcgagtttattatgtttgccagcggtgacggaagagtgcgtgttgaatgtcgctttgagtcagacacaatctggttatcccaggcggcaatggctgaactgtacgataaagatgttcgcactattaacgaacatttaatcaatatattttccgaaggtgaacttgttcaaaactcaaccatccggaaattccggatagttcgccaggaaggaaaacgtcaggtttccagagagatagaccattacaacctcgaagccattctcgctgtcggctatcgcgttcgctcgcctcgaggcacgcaattccgccagtgggccacccagacgcttcaggaatacctgatcaaaggttttgtgatggacgatgagcggctgaagaatccgcctgtcggttcatcggttgtgcccgactattttgatgagatgcttgaacgcatccgcgatattcgcgccagcgagcgtcgggtatatttgcgggtgcgggagatctttgctttagctgccgactatcagccatcgcttaaagaaaccacgcaattttttcaaaccatccagaataaactgcattttgcctgtaccgggcataccgctgcggaactcatccacaaacgagcagatgccaaccagccgcacatgggcttgaccagttataaaggtgaagaggtacgtaagggcgacgtgacggtggcaaaaaattatctcacccaggatgaggtcagcgaacttaatcgcgtggttaatatgtggctggactttgccgaggatcaggcccgtcgtcgtcagcaagtctttttgcgcgactggcaggataagctggatcagttcctgcaatttaacgaccgagaggttctacagggcgctggtaaaatcagcaagaaaatggccgatgaaaaagcgcaggcggagtatgttcagtttgccgaacaacaacggcgcttaaaagaagccgaaggcgagaaggatatcgctggtttgctacagtggaataaagagtcgaaaaagtagcccggaatccccccaaacgccatacgcaaaaccatttgggggtacttatggggttactcatttatcaaattcaaaatataaacattaaatcaataacttaaccatcaaatgcgactcctgtgatcgccaaaatgcctcttcagtgatccccatcctgcttatttctgagcaacctgatcctgctgatgtatctggtagtatgacagagtgattcgtttttcttgccgagtgtacgaaaacgtcttccttgccaccgactatcaaccgtcactcaaaaaaacctctctttttttcaagctatcaagaataagttgcattttatctgcaccggacaccagccatccatatatggcttttacctgctacaaagatgaagaagtgcataaatgtgatgttaaaacaatcaaagaaaaattacatgcgcaataatttcactataacattataatccatggtgaaaataacactgcacaaggattgtcatcatcaaactcatcggaactattttttctgtcgtcattggtgtaatactgattgtaagtatcctttcaggagattatttttgccgtgtggggcatggaacttgtaaagcagccaaaagcgctaggcatttaattgaaagtaaagagaaaaacagaagtagtcgcgtcaaagtctttagcacgcatattaatttgagtcatccagcggcatcctggctagcaactcaaacttgcgctaccaatatattcaatctgtttcaaaacaataatgccatttatttattcgaaaacgataataaaattgaactgcgaatggggcatgattcttttttctctattgaaacgattgataaaattaacaaagaaaacatcaaagaaataaaactaaaaaatgagacaacatatatttatcttcctaatccaaccattttaataaccacgacatcaacacctgaacgacagttttctatttctgttctgaatgatgacaacaaagaaaatatacctaccgataccgcaccttgttttacaattggtattcctgatgaatatactaaagccatagagttattgaacattaaataattaaatttcatagtgagtttttttaaataccatatgaataattgttatatgtcattatttcctccattcactaaaactgattgattactctactccctcaccgtcatcggtagtggtatccttaacgtatattgatgaaaagacaaaacagtatgcagagggaaaaatgggttccaccagaaaggggatgctgaacgttctgattgccgccgtgttgtggggaagttcaggggtctgcgcgcaatacatcatggagcaaagccagatgtcgtcgcagtttttgactatgacgcgtttgatattcgccggtttgattctgctgacgctatcatttgttcatggtgataaaatcttttctattattaacaatcacaaagatgccattagcctactgattttttccgtggttggcgcgctaaccgtacagctcacttttttgctaaccatcgaaaaatcgaacgcagccacggcaacggtgctgcaattcctctcaccgactattatcgtcgcctggttctcactggtgcgtaaatcccgcccaggcattctggttttctgcgctattttgacatcgctgatcgggacttttttattggtgacacacggtaatccgacgtcattatcgatctctcctgccgcgttattctgggggattgcctcggcatttgctgctgcattctataccacctatccctcaacgctgattgcccgctatggcacgttaccggtcgtcggctggagtatgctgattggcggtctgatcctgctgcccttttatgccagacaagggacaaactttgtcgttaacggcagtttgattctggcgtttttttatttggtggtcattggtacgtccctgacatttagtctgtacctgaaaggagcacaattaattggtggtccaaaagccagcattttaagctgtgcagaaccattaagtagcgcgctgctctctttgttgttgctggggatcaccttcacattgccggactggctgggaacgctgctgattctgtcatcggtgattttgatttcaatggattcccgccgccgcgccagaaaaataaatcgtccggcgcggcatgagtgagaattaccagccaggcaccgcgccaccgttaaaaatggtttctgccgctttagcgacttcgggtgattgataagattgcagaaattccttcacgttttctgcattcttattatcttcccgtgccaccagaatattcacatacggcgaatttttatcttcaataaatacgctgtcgttaaccggagaaagtcctgtttgctggatgtaagtggtgctgataatcgctacatccactttcgggtcgtccagtacacgtggcaactgtgccccttccagctccattatctgcaaatggcgtggattatcggttatatccaacgcggtaggtaataacccttttccctctttcagagtaattagcttctctttttgcagcagtaaaagcgcgcgaccaaggttagtcgggtcgttggggatcgccactgtcgcaccttcttttatttgcgccactgttttgatttttttggaatagcccgccatggggaagacaaacgtatttcccaccgctaccagtttataaccatgcgcctgattatcttgttcaagaaagggtcgatgctggaagacgttcgcatcaagctcgccatgatttgtcgcatcgttcggtagcaacgaaccgctaaatcctaccagttcaacatcgagcccatatttctcttttgctacctttttagcgacttccgcgacatcttgttctgcgccattaataacgccaactttaatatgcttttcatcgctgctgctctggtcgcaacctgccagcagaactcctgccagtaataatgcggcccccgcccgtagatgatgtgttgtcagtttcatttttttatccttttattaatgattacctgactatagcggtaaggtcgctgcagtttaaaaaacgaaacgctatcgataagaataaaaaggaataaaagtggaatataaagtctggcacttcttactgaccacgcaaacacctttcgtacagcatgatgagagcggcaaaagcaaactacacttatgcttcattcgatgcacatttgcagaaggttgccgctatgaagccaacgatgctactcatgattaccgtattcctgatttttccagccatttctcaggccgagtcgccattcagttctctacagtcggcaaaagagaaaaccacggtattgcaagatttacgtaaaatttgcacgccacaggcgtcattatcagatgaagcgtgggaaaagttaatgttgtcagatgaaaacaataaacaacatatacgcgaggccatcgtggcgatggaacgtaataatcagagcaattattgggaagcgttgggtaaggtagaatgcccggatatgtaagaacggcaacaaccactgaccaacgcttctttacctgatatcaggatttcttcattttcacctttgcagtcaccaacaatgcagtcagcaacatcaatgtgccggacaacatcagcggcgaagtcagaccaatgttatccaacgcataaccgccgattgccgcaccgcaggtgttagcaagctgaataacggccacctgaatagatccagccttttctgcctgatcggccaatgagcgagtgatccacgttgaccaaccaacgggaattaaagcaaaggtcagcccccagataatcgccacaccagtagcaacaattttatcgcttccccacagcgtcagtaccagcgcgctcagggcgagcacaaacggtgcgcccgctaaggccagtttcaccgaacgtttgagaataaacgacgaaagcgatgtcccgacaaagctggcgataccaaaactcagcagcaccagggttaagccatcaacaccgaatcccgccagattcatatacactgggcgaatataagtgaaaaaagcaaactgtccggcaaaggacataaagatggcgatcatcccggccatcactcccggacgttgtaataagcggaaagtattttgtttctgatgcgaaggttcacctggcagcgaaggcagtgatttgataatccagaaaatacacagcacacccatcgccgccgccgcattaaagacattgcgccaaccgataagctcgcctaaaaaactgcccaacggcgcggcaatcaccagcgcaatagaaaccgcgccgaagatcaccgacagcgccttcggcaccgtacgcggcggtaccagacgcatggtcagcgacgccgacatcgcccagaacccgcccagcgccagccccagacaggcgcgaccgattaacagcagactgaatgagttggcaaaggaaaccagcaaacaggaaagcgtcagcaaaacggcgaacagaatgacaacgtagcggcggtcagtggcctgaatggtctgggtaataaacaaactggcaaacatcgccacaaaggcggtcacggtcaccgattgcccggcaaccccttccgaaatgcctaaatcctgggccattggcgtcaacaaactgacaggcaaaaactcaacgataatcagacaggcgacgcaaaacgccaccgagaaaacggctgaccagttcggtcgggtgatggcattcgcgccgcggttttcagcaataaattcactcatggtgttacccgtggcatgtttcaggggaaaagccgaccagtctaacattgaaatgtgtgatgcatttaacgtttttgcaacttttacgatgttgcttgagctggagttaagatcgaaacggaacagggcaaagattaccggatgcggtgtgaacgtcttatccacccaccaggtcaggcgcggtctgtaggctgataagacgaagcggttttaatgcagccagtgaacgccctcggcaggctgaaagaacgcgttatagcgcatctgaaaagcattgatatcctgcatttcaggttcggtttcgcgcagaaaacccagcgccagcctgacctgagcatcggtaatcggcgcggcaaggcgggctttttgtaaaatccgatgccattgcagcaggttctgttcgctaccatcgacaatgacaatttgccagatgagcaacacctgcgcggcgttttgcaggtgcgactcatccgggcgatgcaaataacgtaaaaattcgtcaccggctgactttcccatttgatcgaccatcgactccacgggtacgacatcgatgttcagccgatcgctgagacggcgaatcgcttttctggccccggatgtcagcacccgaaaaccaaccacaaacactaccgccagcgtggcgagcattatccagatcatgagttctcctgcgtaatcagaactcatgatatctggaaaccctcgccagttactaatccaccagaataatcttcagtgcaaacagagttgcgaccaccaccacgcacaggttcagatcgcgccagcgcccggtgcacactttcatgatgcagtacgacataaagcctagtgcaatcccttcggtgatcgagaaagtaaagggcatcatcaccgtggtaataaacgcaggcaccgattcggtaaaatcatcccagttaacgcgcgccaagcttgaagtcatcagcacgccaacaaagattaacgctccggcggttgcgtaaggaggaaccatcgccaccagcggtgagaagaacataactaacaggaacataacgccgactacgacagccgtcagacccgtgcgaccaccgacagccacacctgaagtactttcaatacaggcggtaacagacgaggtaccgataaacgcacccgccaccgaactgacgctatcaacacacagcgccttattcatattggggaatttaccgttactatctattaagccagctttatcagtcacaccaattaatgtccctgatgaatcaaataagttgatcagcataaaggagaaaatgataccggcgagttcaagtgataacgcaccgctcaaatccacttcaccaatgacgccgctaatatcaggcggaatggaatagacgccgctaaaatgaacatctccgaaaaacaatccacagcaagacgtcaccacaatagaaacaagcaccgcggcatgaaaatgacgtgatgacaacacggttataataaaaaaccctaaaatacctaacaacacgccgtgagaacttaaatcgccaatcatcaccagggtgtctttattggcgacaataacgccagtattttttaatcccattaaggcgataaataatccgattccgctggtgataccaatacgtaaactaaatggaatgttggagatcatccagtaccggatacgaaacagcgtgagcaaaaatagcccaactgcgccccagaatatcgcgcccatcccggtctgccaggagatacccatcgcccccacgaccacgaaggcaaagaaggcgttcaggcccattgccggagccagtgccacgggtaagttagcaaatacccccatcgcaatactgccgataccggcaatcaaacaggtggtaacaaacaccactttcgggtccatttgtgccgcgccgaggatttgcgggttcacaaaaacgatgtacaccatggttaaaaaagtggtcatccccgcaatcaattctgtgcggacggtggtcccatgctgaggtagtttaaataatcgcgaaagcgtccctgattcattactcacgtaatcggtattgtcattattcatttttttgtccattggaggagatttaatcccttgcttttgtaaaacaaatgacaacaacggttcagtgataattatcacatttcaattgcacattaatggatattctttaataatctcgcgacgtttctttatgataaataataatcaaattgataaaatcaaaatgagaaaaatatgaataattctattaaccataaatttcatcacattagccgggctgaataccaggaattgttagccgtttcccgtggagacgctgttgccgattatattattgataatgtctctattctcgacctgatcaatggcggagaaatttccggcccaattgtgattaaaggacgttacattgccggtgttggcgcagaatacgctgatgctccggctttgcagcggattgatgcccgcggcgcaacggcggtgccagggtttattgatgctcacctgcatattgaatccagcatgatgacgccggtcacctttgaaactgctaccctgccgcgcggcctgacgaccgttatttgcgaccctcatgaaatcgtcaacgtgatgggagaagccggattcgcctggtttgcccgctgtgccgaacaggcaaggcaaaaccagtacttacaggtcagctcttgcgtacccgccctggaaggctgcgatgttaatggtgccagttttacccttgaacagatgctcgcctggcgggaccatccgcaggttaccggccttgcagaaatgatggactaccctggcgtaattagcgggcagaatgcgctgctcgataaactggacgcatttcgccacctgacactggacggtcactgcccgggtttgggtggtaaagaacttaacgcctatattgctgcgggtattgaaaactgccacgaaagttatcagttggaagaaggacgccggaaattgcaactcggcatgtcattgatgatccgtgaagggtccgcagcccgcaatctcaacgcgctggcaccgttgatcaacgaatttaacagcccgcaatgcatgctctgtaccgatgaccgtaacccgtgggagatcgcccatgaaggacacatcgatgccttaattcgccgcctgatcgaacaacacaatgtaccgctgcatgtggcatatcgcgtagccagctggtcgacggcgcgccattttggtctgaatcacctcggcttactggcacccggcaagcaggccgatatcgtcctgttgagcgatgcgcgtaaggtcacggtgcagcaggtactggtgaaaggcgagccgatcgatgcacaaaccttacaggcggaagagtcggcgagactggcacaatccgccccgccatatggcaataccattgatcgccagccagtttccgccagcgactttgccctgcaatttacccccggaaaacgctatcgcgttattgaggtaatccataacgaactgatcacgcactcccgctccagcgtctacagcgaaaacggttttgatcgcgatgatgtgtgctttattgccgttcttgagcgttacggacaacgactggctccggcctgtggtttgctcggcggctttggcctgaatgaaggtgcgctggcggcgacggtcagccatgacagccataatattgtggtgatcggtcgtagcgcagaagagatggcgctggcggtcaatcaggtgattcaggatggcggcgggctgtgcgtggtccgtaacggccaggtacaaagtcatctaccgttgcccattgccgggctaatgagcaccgacacggcgcagtcactggcggagcaaattgacgccctgaaagccgccgcccgtgaatgcggtccgttaccggatgagccgtttattcagatggcgtttctttccctgccagtgatccccgcgctgaaactaaccagtcaggggctgtttgatggtgagaagtttgccttcactacgctggaagtcacggaataataaaaaaagcccggcgtcatgccgggcaaaagtcaccagttacgtttatgccactgtcaactgctgaatttttttctcgcggcggattttgcgttcttccatcaccgctactatcgccatcaggcagatacaaccaatagcggcgatatccagcgcggcgaaggtgcctgcccagccggtaaggccaaataccggcgtcccatcggcaatcattcccagacctaacttggcaaagctgtcaccaatcaggtaagcgaaggtgcctttaataccatcggcagcgccaatcgcttttttaggtacaaagccaacagccgccacgccaatcaacaattgcgggccaaagaccaggaaacccaacgcaaagagagaagccaggtagatatattcgttgctggcgtgttgatacacaccgagcgtggcgataatcagcgccagcgcgatacaggccaccaggccacggcgaccgttcgccaggtcagagagccagccccacagcagcgtaccgaccagcgcaccagcttcaaacagcgtaaagccctgaatcgccaccgctttagagagtttcagttcctggaacgcatacacggttgaccactggtcgataccaatacgcaccacatagaggaaaatgttggcaaagcacagcagccagatcactttgtttttcagcacatactcaacaaagatctgccacttggtcatatcggtagattctgtctctttatcctcttcactgatctcctcgccaaacagctcttcagctttgccgaggccataagattccggggagtcgctgccgtaacgcagaccgataaaaccaacaatcagcgcgataatcgacgggaaaataaacatgccgatgacatgaccatcgaacaggtaatttgcgccgaacagcgccacacctgctgcgcctgcaccaccaaggttgtgagaaatgttccagaaaccgaggaatgtcccgcgtttacgacgcggcgtccatttggtgatggtggagtaactgcacgaaccgccggtactctggaaaaagccgctcaaggcgtagaaggcaatcatcaggaacaggctaaccgagccgctgcccatactggcactgaagcccagcatacaaatggcagacaggatcagcatgaacggcaggaattgtttggtgtttttgccgtcggcgtagtaagaaaccagcgttttacccacgccataagtgatggagaagcccaggccgatcatccccagctgcgtcatgctcaacccgtaggtcgagatcatgtcgttctgcgcgatgttaaagttcttgcgaatcaggtacatcgtaaggtagccgataaagaccaccaggtaggattgcatgaacggtttgaaccacattttgcgccgcacttcgagcggaaggtccagggtcggcttgcgaacctggtttaagaaagccagcatgggttactcctgaaatgaatacctgcgtgaggcatgcattgtaaaaatcagcagcaaatcaggcctgagatagcgtccaggcaaaacctggaaaatttcttagttttgccggatatgaagtgaaaaggtgagatgcatcacgcttctcgcggtgtctgggcgttcaaaaagggcagtaatagcagtgcggaaatcccggcggcgatggcgataaccacaaaaaatccgctccagtgccaggtatcgagtactttcgccagcggccaaccagcaagcgacgcaccaagataagcaaacaagccgacaaatcccgtcgccgcccctgccgcctctttgtgggaacactctgccgccgccatgccgattaacatctgcgggccaaagacaaaaaaaccaatggtgaagaagcaggttgcctgcatcacgtagctggcaaatggcatcagccacagcgagccgactgaaagcaaaattccggcggcgaaaatcaaattcatcggcccgcggttgccgttaaacagtttgtccgaaccccaacccgctaccagcgcaccgataaatccgcccagttcaaacattgtcactgccgtattcgccgtgaccagatcgacgcccagcgtctcggacatatacaaattgccccagtcgttgatcgccgcccgaaccacatagaccagcacatagcaaaacgaaagcagccagatatacggattcagcaacacatatttggtgaggatctctttacgcgtcagccctgccccttcttgttgttgagcaatctccagtgcgtcgtgccgccattcaccaaccgccggtaaacctaacgcctgcggacgatcgcgcagccgccagcagagaaaaatccccacgacgatcgccatacaacccgcaatcatcatcccggcacgccagccgtaatgcagcgcgctcgctgccatcacaatgggaatgagtgcgccgccgacgttatgcgccgtgttccataatgcccaccaaccgccgcgctcggtacgagaataccaagcggttaacagacgcgcacacaccggtgaaccccagccctggaaaaaggcgttcaacacccaaagcacggcaaacgcccatagcgacgtcgagaagccaaacagaatgttgataatgcccgtggcaataagccctatccccataaaataacgggcatttgagcgatcgctgacaatgccggagacaaacttcgacacgccgtaggtaatgtaaaacagggtcgctaacaggccaatatcgctacggctgagcacgccgttagcaaggatttctggtacggcggcgttaaaacttttacgcgtgaagtaaaacagcgcgtaacccagccagatggtcagcagaatatgccgacgccagtagcgatagcgggcatcaatttcatgtttatcagtcattaatggcgcatcggcaggcgctttcagaaacggcaacatcatcgaaccttagacataacgttgaggtagagaaacgctgacacgcgtgccgtgcagacaggaaatggtcaatgtgccacccagcgccgttacgcgctcgcgcattccggtaaggccaaaaccgtgttgcccggaatctggcggtaaaccgctgccatcgtcttcaatcaccagcattaaccgctcatcatgctgccagccttgcagcgtgaccgcgctggcatcggcatgtttcacaatgttgttcaacccttcctggcagacgcgaaacagcgtcacgcgctggttttcgcttaacgctgattcatcgattcgccattcgagatgactgacaatgccgcgcccttccagctccatttcccgcatcagtgagcggatggcctgctccagggtgagatcatccagctggcgcggacgtaaccgccctaacaagcggcgcaccgcgtcgtaaacgcccaacgacaactgttcgatgagctgcccgctctgtttcacgctggcgttatccgccgcgagccgctggacaatgcccgcttgagttcgaatagcagtaatggtctgaccgatatcatcgtgcagctcacgtgccacatcacggcgcacgctctcttcggtttccagcaaccgttcagcgagatgctgattgcgcgccagttccttttgcagcgactggttaagttcacgcaaccgctggatgccagcgcccaataacaaccctgtcagactttgcaccagcagcgagagcaataaatccaccggatgatcgcgccaggtttgactggcgatcagcgcgatggcgttcatcaatgtcgcaatcagcgctccttgccaaccatagtgccaggccagcgcgataatcggcagcgccagacagaatggcgtaaagcgcgacagttcgtccggcaatcccaactggagccagagactgataacaaacagcagcaagtaccagaccagatgccgcccacgccagttgattggttgagaaaccagtgacgggccgagcggcagccaggtgttattggcgagatagtgccagaacaccagacatatcggggccagcgtcaggccgccagttaaagtcagcagtagcgcattccacgactctttgccgtgccaaagccagggcagcgactgcaacaacgccgccgccgttaatgccgcaccctgtaacagcaaggtgcgccagtcacgttgatggcgatagcgcgagatcagcgccacgggcagtaacgtcagtaaactaccgatcatcaataaggagaaatgggttaaaccgaccgcctgcgttaaccagtaaatcagcagccactccgcgcccagcaacaccggccagtatccgcgcgggcattgcagcattagccctagccgcaggccaaacggaaataacagtaccgccatatcagggcgctcaaccaggtgcaggctgatactccacaggcaaaaccatgcggcagagaagataaaaaagcaggcaataacggtaattaagcgggagaacaacgtcttcatcaccagccatcaaacatgcggcgcgccagttcaacgtcgttactgacgcccagtttttccatcaggttggcgcgatggacatgtaccgttttcggtgacaagcccagttcggcagcaatctctttcaccgccattccttgcgccagtttttccgccacctggcgttcgcgtttggttagcgggtcctggcgaccggatgccagtttaatggcaatatccggcgtcagataacagccgcccgtggcaaccgtatgcaccgcagcaatgagttcatccgggctacagcgtttggagagaaagccgcgcgcccccgcgttaagcgcctgctcaaccagcgccggactgtcatgaacggagagcataattgtcgccatgcctttcggcagctggcttagaagctccagaccggagatatcaggcatggagatatcgcaaatacacaccagcacaccgcgccccggcagccccgccagcgcctcgcgccccgaaccaaactcggcaactacctgcaaatcaggttccagccccagcagctgcgcaaagccggagcggacgataaggtgatcgtctataagggcaacggtgatcatggtcttgtcctggcgggtaataaaacgcgcttaccttaacgataagcgcgccactgttcaagccttgagcggttactgaaaaaagctgcgctcctgttgcttgtgaaaagaaatgatgccttcaaggtttggtatatcgactaatcattaaaaacgctggcagcattaataccttgttagtatccattttgaataagaaaaatatatattttatatttatagtttgattgtttgtatatttatgaattattacttcagtataaagaccactctctaaataattcgcagacacagcacatgcaacttgaagtatgacaagcatgcctgcttcattattacactttaataataaaacccaccgattaatgtacaaaaaaatccctgcgtgatattgtctgtaaaaaaggagcagatatgcgcactcaccctcacttaataaaacaaactattgatccacgactcattaatgaaataaacaaaagaacacaaagcaacagtgagaagttatcaaacagtgataaattaacatatattaatgacaactactgtgagataacgcgaaactacacgtcattttatggtatgaacatgctgagcatcgttcttttcttacctatcgttattttatgttttgcctctgttttattctttatatatgacataacatttaacttcgaacgatacttagatacgtggagatacagagcagactctgagttaatgctacatattgcttactgcgcaatttttttcatgtcttttgtttttgctgctattctaaattattttatctttgctccgcgacattacccaatccgttttaatagaaaaacaggaaaggtctatatttgtgattatattcttaatgatatgagtcataaatcaacctatactttctggtggcactatccattctataaacataccaagcctgaatataaagagtacgactgggaacaaattcaaggtatagctttttttgcacaaaatcgccattcctcatactccactattcgctgtattgtttatgaatcattagacagtacaaatattattgacacctttaacctgataacgacagagagtgctatagatgcattgcatatgacaaatcacaaattatggttatggattaatagctttatgaattttgacgatgagtttttagagaaatctatcaatactgctccaggtatttggggccgtgaagtgaattggcctgaagatatgaataagaaatcaatgttgtcttcaatggacgaatatatactctgaataattcgagttacagaatatactcgtcatacttcaagttgcatgtgctgcgtctgcgttcgctccccccagtcacttacttatgtaagctcctggggattcactcgcttgtcgccttcctgcaactcgaattatttagagtatataagctcgcccggatgtaaatatcccatccaggcgagaaaatcacttactgaaaaaacaccgcaatcttgttaaacatcgtcggatcggactgattacgctgcactttcaccacatcttccagcttgtctatctggcttatcatctgctccagacgctggtcgtcattgaccagtagccagatgtggcttttgtcgctgtcctgaatcggcaggcagagaatgccttcaacgttaaaagcgcgacgggcaaaaaggccacaaacgtgggtcattacacccggatggttgcgaacggtgagttccagaatcacgttatcatgagttgtgttttgcatggcttattcccccaccatttcagtattcgccgcacctggcggcaccatcgggtacactttttcttcggcatcaatgcgcacatggatcagcgccgggccagggcgattgatgatttcctgcaatgcagcctgcggatcggcttcgttattcaaatcacaggtttcgaggccgaatccggcggcaatctgcataaagttgattttgcccggataggtagcggcaaaaacgccctgcttgtagaacagactctgttgctgatgcaccagccccagcgcttcgttgttcatcaaaatgattttaacatccagctgattttcactggcggtcgccatctcctgaatattcatcatcaggctgccgtcgccggagaagcacaacactttgcggtccgggttcgccagcgccgcgccaatcgccgcaggcaggccaaaacccatcgtgcccagcccgccggaggtcagccactggcgtgggcgattgagcggataggcttgcgcggtccacatctgatgctgacccacgtcggtggtgataatcgcattgtcatcgacacaggcggcaacggcgttgatcaggccgtaatggcttaatggatcgcacgctttcgggattggacacgggaattcacgctgcaaatccgccaccaactggtgccactctgcacgcggttgcgcttccaccagcgggatcaactgcgccaacacgtcatcaacatccgcctgaattgccacatgcggttgcttgattttgcccagctctgcgcggtcgatatcgacatgaataattttggcattcggacagaactgctcggttttgccaatcgcccggtcatcaaaacgcgcaccgagtacaatcagcagatccgcctcctgcaaaatatagttggtgctgcgcacaccgtgcatccccagcatacccagcgacagcggatgcgcttttggcaacatacccagcgccattaaagtcatggtggtaggcagttgtgctttctccgccagttcacgcactcgcgcaggcgcgttgatcacaccaccacccagataaagcaccgggcgtttggcggcgttaatcatcgccgccgcgtcacgaatactttcttcgctaaaggcgggtgcggcggctttttctgccatagcgggctgtgtttcaatctcaaaaactgccgtttgcacatccttaggaatgtctatccacaccgggccagggcggcctgattgcgcaatgcggaaggcatcgctcatgacctgcgggagttcttcgatatgtctgaccagatagttgtatttggtgatggggatagagatgccgtaggtgtcgacttcctggaaggcgtcggtgccgatcatcgaggcgggaacctgaccagtgatgcaaatcagcgggatggagtccagcctcgcatcggcaatggcggtcactaggttagtcgcacccggtccactacaggccatacagaccgccggtttaccgtcggtgcgcgccattccctgagcgataaaccccgcgccctgttcatggcgagccagaatatggcggatttgcgtgctttggcttaaggcatcgtaaacaggcaggatagaaccgcccggaatacccgtcacaatcttaatgccctgctgttccaggaaatgaacgataaattctgcgccggtaaagcgcttacgcgtcgatgttgtgcccgaacttgccatgctccagtccttttcttctgggccgactttccgggaggagcttaaacgaaaaaccccgcccggtttgcgccggcggggttttggaatcgtgtgttgttccagtccctacggcgcattgccgacgaccaccaccacacgcacgacgaccactgcggcggatggcgcagttggtagtagttttgcgttgaacatggaagtagtcattggggaccttgttggttttgtgtttaacaatatttatacaagcacagctttacaggggagacaatggaaaatttttcttccggataaaaatacgtggcagatcacattttgaactgaaactcaggcaataaagcatcatcacctgaaagacggtcagattgttgacagagtgcgccttattcatgtcgaatacagcgtaaacaccttaccctaccaaccgcaccatcactgtttccggcaacatttattgccgcttttgtttacatattctgccgctaaacaattccccattcctggcgtatatctggctaacattcatcaatgtgatagattcctctcccgcatttatgggaatgcgtagtgacttattctaattatttttataaaagcatccgtgataatgaaaaggcatagaaacgtcaatttgttattgatgttggtattactcgtggccgtcggtcagatggcgcaaaccatttatattccagctattgccgatatggcgcgcgatctcaatgtccgtgaaggggcggtgcagagcgtaatgggcgcttatctgctgacttacggtgtctcacagctgttttatggcccgatttccgaccgcgtgggtcgccgaccggtgatcctcgtcggaatgtccatttttatgctggcaacgctggtcgcggtcacgacctccagtttgatggtattgattgccgccagcgcgatgcaggggatgggcaccggcgttggcggcgtaatggcgcgtactttgccgcgcgatttatatgaacggacacagttgcgccacgctaacagcctgttaaacatggggattcttgtcagtccgctgctcgcaccgctaatcggcggtctgctggatacgatgtggaactggcgcgcctgttatctctttttgttggttctttgtgccggtgtgaccttcagtatggcccgctggatgccggaaacgcgtccggtcgacgcaccgcgcacgcgcctgcttaccagttataaaacgcttttcggtaacagcagttttaactgttatttgctgatgctgattggcggtctggccgggattgccgcctttgaagccagctccggcgtgctgatgggcgcggtgttagggctgagcagtatgacggtcagtattttgtttattctgccgattccggcggcattttttggcgcatggtttgccggacgtcctaataaacgcttctcaacgttgatgtggcagtcggttatctgctgcctgctggctggcttactgatgtggatccccgactggtttggcgtgatgaatgtctggacgctgctcgttcccgccgcgctgttctttttcggtgccgggatgctgtttccactggctaccagcggcgcgatggagccgttccccttcctggcgggcaccgctggcgcgctggtcggcggtctgcaaaacattggttccggcgtgctggcgtcgctctctgcgatgttgccgcaaaccggtcagggcagcctgggattgttgatgaccttaatgggattgttgatcgtgctgtgctggctaccgctggcgacgcggatgtcgcatcaggggcagcctgtttaagctcacgtcaccgcagcatcgtcatcagctccatgggagaacgatgctgctttatcagatcacgcatcacccgcatatgcggcgcggagtaagaataaaacgcctgatagcccgcacaaagcacgttgtctggtttatcttcccgagcgtgcgggcacagccgatgccagtcgcacgcctggcagtcacggcgcggttgcgacttttcgctgccacaccatttttgtaaggtggtgtcaaaaagttcaatcgaaatacgactgatatctgcccgcacccaacactcgaacagggcaattaaaaatttcccccacagctctgctgtcaccgaagcggccgtcagatcgccccggtcatcaaattcaagatggggaataagctgtactgagcggatgcccagctgtttgaaattgtgataaaaatcggcaggttgcagagcatccttatactctacaaccagtttatgcctgtcctcttcagcatcaatgacctgacttcctgtcatgcgactctctcaataaatacgataagttgatgtatatgcgttacagcaaacagtattgcgagagataacaccgcgagggagatcaaaaatttgtcacggactacgtgaaattgggaaaaatcgctattcgtgacatccattaaattgcgattacgggtgtagtgccagaggatcagcgccacgatggcgaggatgccaatcgaaatccagaataacatgcccgcctggtgccagctgtgtttgatagccaacgccatcaacgcgccgtagcccagcatggtacgaaaccacgccagtgatgtgcgttccggctgcagccctgggtcggcaatgcgtctggctttgcggctatccggcatacaacaccagtcccatgacgatcactgccacgaccatcaatattaagctgatgattaataagctgttggtatagggcaggtcctctttcaggcgcatcgctttttcattgcgtaaccagcgcaagtagccatacatcgctaacccgccggaaaacagacacaacaacaacgccagcagttcgcggatgacgggcgtggcgaaatctggcgcaagttgatcaagcccaacccccgccgccagaaatcctagtgcagtacggatccacgccagaaaagtacgctcattagccagcgagaagcggtaatcgggcgcttctccgaggcgggaaattttcattgttgctccttgtaaactgttcctcgccgaaaaattaggccaggaacagcaataatgcatcagaacttctgttttttctcttccaccttcaccccttgtgtcggtaaaccggtgtcatagtcgcgtaccactggagaataaccatcctgtgggcgtggacgaaacgcccccatccagcgcggttgtgcatctttgcgccacggacgcaggttccattgataactgcggaacggatcgcgaattttgtccatgtaatccaataaggcgtcatgcattttgctgcgaacgtcggcaaaatggatatcatcgatcaggttatgcatttcatttgggtcattacggcgatcgtaaagttcatcactggtgaagaggttgagcaccagtttaaagtcatccgttacccagcaacgcaccggaataaaaccgccaaagctgtcatgctcaatctcgtagcgattaaattccaccaacacgccacgtggctctttcacggcaaggatattttcccccggcagaatctctggtttttcaatatctgccagcgccatcattgtcggcagtaagtcaatatgactgactggcgtatcgacctgtcgccgctccccttgcggcgaacggatgatcagcggaatgcgggtgatgtcgtcatacatcgccgctcctttactgatcagcttatgtgcgcccatcatttcgccgtgatcggaggtataaataacccacgtattttcacgttgctctggcgttaaggcgttgatgacccgtccgatttggtcatcaacaaagtcattgcaggcaaaatagagcggatggtgataaagcccgtcatcaccgactggcgatggcatcgcctgcgcccataagcggtgatgttccggtttgttcgccaggtcatcctctgctttctcacccagttcgtagtaaaaatcagtgtatttctctaaatactccaccggacaggtgaacgggtgatgcggctcatcatacgaaatcaccatcaggaaaggttcgtcggcgcgcgcgggctgttgcagaaaatccaccgcccgattgctgatgcggtgcgcccaggtgaaggtttcgtcaatatggttcgcctgtaaatcctcaacgctgtttaggccattgcgccacaggctaatctctttctccgtcagttcactaaaatagttcgcgccatcgaaccagtaatcagcgtcccactccggcggacactcgccagtgccgaaatagtcatgtccatcgagatgccatttgccgatgtagcaggtgtgatagcccgcatccttaaagtagcgccccatggtggaaatgtttttgcccggcgcgacgttgttggtccacgggccggactggttagcgtagataccggtgaatagtccggcgcgtgcaggtgtacaaaccggtgaacaggtgtaggcagaattaaagcgaataccttctgccgccagactatcaatattttgcgtattcagcggtttaccgctatagcaaccgaccatattggtggcctgggtatcggtcatgatgaacagaaaattggggcgtttcataggctatccttcgcatcgggagtaaaggtgacggctgggtcgtgacgatgccgccagctgtcaaaaatcaggtagacaatcactacggcggcgatgaaataactgatcatcgctaaccagcgcgtaccgtagccaccgaattcagccagcccggcatagacgccaatcatcgcgaacaggataccaattgacgcaatcttgacgtttttccacggtttcatgtccaccgcaaacgcatctttgaaggtgagcggcgtggcgcgcggtttgataaaaccgatcatcagcatcacgaccacgttgatgcagaacgtacaggccagcacatagaggaaatggaagtcgaacttcaccagatagttgatggtgatgtagctgattatgccaatccccatcgccacttttgccgccagcgccggaatgcgcgggaagaaaaagcccataatgatgatggtaaccagcggcacgttgtaaataccgttgagctgtttcatccagctatacagcccctgcggcgcgttggcgatccacggcgcgaccatcaccgaaacgacggcgataaagaaaccaaatttgcgcccgacggtgaccagctgttgcggctcggcattctggttaatgatgcgccggtaaatacccatactgaataacgtactggcgctattcagaaagccgttgaaggtactgatcaccgcaccaaataacaccgcaccgaagaagcccaccagtggcaccggcagaacgttattgaccagcgtcgggtaggccatgtcggctttcggtaaatcctgatacagatgaaacgcaatcaaccctggcagcaccagtaccagcgggtcgagcattttcagcaccgccgttaacagcgcccccttttgcccttccgccaggctttttgacgccagcgtgcgttgcacgatgccctgatttgtacaccagtaaaaggtgttcaccagaatcaaaccggtaaatgccgcgccaatcggcaagggatcggtcgggccgccgactgagtttaatttctcggcgtgaacggtggtgagttgctcaatgccctgcataaagctgcccttgcccatcgcgatcaggccaaataccggcaccatcaacccgccaataaccagcccaataccgttaatggagtccgccactgccattgcgcgcagtccgccgatcaccgcatacaaaattcccgccaaaccaagcaaaatcaccagtaaccagatagccgcaccatcggaaagttgtagcgactcacccacatgaaacaggctgttgagcgccaacgcgccggagtagagaacaatcggcagaaagcagacgccggtggcaatgaggaagcagaagtcgatgataatacgcgtcgttttatcataacgttcctccagaaaatcggggatggtggcaatgccgcgcttcagatagcgcggtaaaaagattagcgcgaggaagatcagcgtcactgcagaggtgacttcccagcccatcaccgacatgccgcttttgtaggcctgcccggaaaggccgaccagttgttccgtggaaaggttggttagcattaacgaagcggcaataaccggcgcttttagtgaacgtccggcaagaaaatagccttgttgcgatccggtatctgttttacggaccttccaccaggtgatgaccgctaccagcagcgtaaaaccgacaaaactcaagatttgtaacgaattcatctcatagcccttatttatgtttatgtcccggacgcatgaatatagggagaggtaaaatgcgtcgggtcaggcagtcagattcttaaaatacaaacgtcgtatccctgaacggattgttttctgttaagttcaggttgtgagcataattcgccggagggatattaaaatgaatggaaaattgcaaagttcggatgtaaaaaacgaaactccgtacaatattcccttattgattaacgaaaatgtgatctccagcggaatttctctgatatcgctctggcatacctacgccgacgagcattatcgggtgatctggccgcgggacaagaagaaaccgcttatcgccaactcatgggttgcggtgtataccgtacaaggatgtgggaaaattcttttaaagaatgacgaacaaataactctgcatggcaactgtattatatttttaaagccaatggatattcactcttatcactgtgaaggtttggtctgggaacagtactggatggaatttacccccaccagtatgatggatattcccgtcggtcagcaaagcgttatttataatggcgaagtttataatcaggaactcaccgaagttgctgagttaattacttcaccagaagcaataaaaaataatctggcagtcgcttttctgacgaaaattatttatcagtggatttgtcttatgcacacagtcggtaaaaaagatccacaacggcggcaaattgaaaaattaattgccactttacatgccagtctacaacaacgctggagcgtagctgatatggctgccacgatcccctgtagcgaggcctggttgcgtcgtctgtttttacgctataccggcaagacgccgaaagaatattacctcgatgcgcgtctggatctggcgctatcgctattaaagcaacaagggaactcggttggcgaagtcgctgatacgctcaacttcttcgactcctttcatttcagcaaagcctttaagcataaatttggttatgcgccgtcagctgtgctgaagaatacggacaggtaataaccagaatggcgagtgtgtaaatgactcgatgatgttcagaaataccaggcggagtaccatttacggcgactccaccgggaaaagagttaaccgatactccagaagagcaccgccagtaattggggtgtgataatgcgcaggaacatcactaacggatagacagtggcgtaagagagcgccgccgcaccgctggttggatgaagattattagcaaacgccagcgccggaggatcggtcatggaacctgccagcatcccgcacatggtcaggtaattcattttggctaacatccgcgccagaatgccaacagtaatcagcggaacggcggtgatcagggcaccataaccaatccagcttagcccttcgccatccaccagtgtatggataaaatcgccgccggatttcaggccaaccaccgagagaaagagcacaatgcctaactcgcgtagcgccaggttagcgcttggtggcataaaccagtacagcttgccgatactgccgatacgcccgaggatcaacgccataatcagcggaccgcccgccagcccgagtttcaacgccgccgggaacccaggcacaaagacgggaatagaacctaacaatacgccaagcccgataccaataaacactggcagcatctgaacctgttgcagtttttgctgcgcattccccagcacattggcaacggcatcaattgcggacggacgccccaccaggttgaggatatcgccgaactgcaggctgatatcgctacttgcaactaattcaacaccagcacggttcaggcgcgagataacaacgtcatagcgttctttaaagtgcaggtcgcgaatacgtttaccgagcacgttttcattggtgaccaccacacgcgcgacgcgcaaatcagtgcctttcgtagacagcgaggtatcgacctcctgaccaatcaccagttgcgcattatgtaaatccgcaggctgccccaccagatgcagcaaatcgcccagttgaataacggtttctggcgaaggcacttttagggtttcttctcgtttcaatcgtgagcaaataactttatcgccattgagaatcggcacatctttaatggctaaattatgcaaattaggattctcaactcggatgttaatcgtcctgattagcgcaccgccgttggttcgcgtggactcgtgctgctgggcctcagtctcaacattgacgcggaaaataacccgcagcatccacatagtgaacaaaatgccgcaaatcccaaatggatacgccatcgcatagctcatccccatttgatcgaccatcgccatcggtgtccccaagtcgcgcaagatctgctgccctgcccccagcgctggcgtattggtgaccgcgccggaaaaaatccccagcactaccggcagtggaatatcaaacagtttatgcaggatggcggtaaccagaccaccgatgatgacgatcagaacagcaaacaggttgaggcgtaatccggagacgcgcaatgaggcaaagaagcccggccctacctgaatcccgatggtataaacgaacaggatcaggccaaactcctgaataacatgcagcatatcgctacttaatgtcatccccgcctgagaaacaaaatggccgacgatgatcccaccgaacagcacgccgccaatgcccaatccaacaccgcgaaacttgacgttgccgataaacaacccgacgaccgccaccaaagccagaatactgaccgttaatgctatatcactcatcgtccatttctcttgaaataacattttaattgctacggattatggctgaatcggtgaagcagatttgccttatagcgcacattatcacgggaaagaacgtgccgaaatatcttaaacaggcgaaatttaacgcattgctgaagaaaaaagacaaaaaaaagccccaccagaatggcggggcaaagagaatagctagttagctatttaacgcgggacgttcgctgatagcgatacgctgcgctgcgatgggttcaggctcattacgaattaaatcaatatgcagtaaaccgtttacgaaggttgcgccagagacttccatattttcagccagcgtaaagctcaggctaaaaggctgattcataagcccttgatgcagccattttttctcttcttttggctgctctggcgtgccttttacgctcaggcgcgtaccttccagttgaatctctaaatcttcctgacgaaaacctgccagcgcgagggtaatgcggtagtggttatcgtcgcttttctcaatgttgtacggcgggaagctctggctttcaccggcgttttgcagtgcgttggccagtttgtcaaaaccgatccattgacgcatcagtggggataaatcgaagttacgcatagtcatttctccttctaagaagcgagtaagtacctgcaaatccgaagattcgcatatgctccctgacggcgagcatggaaatgtcaggccgcgccaggcggccttagggaattagttgatttcgatacggcgcggttttttcgcttccggaatcacgcgttcgagatcgatatacagcagaccattcaccaggttagcaccacgaacatgaatgttctcagctaactggaatttacgttcaaagttgcgttcagcgatgccctggtacagataggtgcgctctttttgttcgtcggcgtgagcacctttcaccaccagcagattatcctgggcggtaatttccagttcgctctcagcaaaaccagccacagcgatagcaatgcggtaatggttttcgtctaccagttcaacgttatacggagggtagccgccattactctggctctggttgttttctaagtggttaaacaaacggtcaaatccaatagcagaacggtaaagcggggataaatcaaagttacgcataatcaatagctcctgaaatcagcgagaatctaagaccttccacaatggacaggtcaggtagccagaacacccatcaggcgcgtcctcatcggctacgatgtaaaaatgggtctggaaatgaacttttcaagccttatcagcggacttttttttgcagtttatggtctattgcatagactgagggggcagcacgaaacgttaaagtgcgatagccgccacagtgcgacgtaatgatgatgttattttcagcaagggatcgctataactcatcaggccaacacccacgatcaacagatgaatttattatgataagaaatgtgttgttagcgttcatgatatgcagcggaatgacattactcggaggatgctccagcgtgatgtcccataccggggggaaagaaggaacgtatcctggcacccgcgccagcgcaaccatgattggcgacgatgaaaccaactggggcacaaaatcgctggcgatactcgacatgccatttaccgcagtactggacacaatattgctaccgtgggatatgttccgcaaagacagctcagtgcgctcgcgcgttgaaaaaagcgaagccgacgcgcaagaaaccaataacgtcattccccccgccaaaatgcctgcaaactgagagctagcggtcagtttcggtgatccacaactgaccgtcctccatccacgccaaccattgaccatccggcgagaaaaccacggcgtccgcagaaggtggattgccgtggttttcggttaaatactcaacctcgccgctttgcgcatgggcacaagcaatccgattatccagcacaaatcccagccattcgcctgatggatgccagttaaatgcagactgaatatccgttttattatgggttaactggtgtggtttaccgccctgtggcgagataagccacagttgcacaatgccgttatcatcgcgcattaaaaacgcaatttgtgttccttgaggattacaacgcacccagtggcgcggaatgttaaccaggcccgggtaaatacgatggtgcgtaaaggttaaacgtcgctgcatgacaccacgcggtggcgcaggcagggttgtttccgttccacttaacggcacatcacctgccgctttccagccagcttcatctttcggcaactcgacaataaacagctccggcactttctcgccctttgccgaaagtgtgtcgccaataaacgccagcgcgtgatttcctacccatccttcttcataagcacgattgatttcatcactgccaggctgtggcgtgggcgtggttttacttaccagcacgcaccagtggctaccgctgtattcacgcggatgctgcttttgtacgttgaccgggccaaacggtgcagcaacaccgacgtttcgcaaatccagcgccggatcgagttcatgcattacatggtcgttgtaggtaaagctcaccctttcaccgttcgggctaaagacatgtacatggctgccgccacgtagcgctcctggcgtatatggcgcggtaatatccattgcatcgagattgctcaccttgccgctttcaacaatcactccgcgccgatgatgaaagtcgtaataccatgtttcatcaggattttccgggccgtggatgaagacatacttctctgacttcggatgaacggtcaccacgccgacgtatgcgccctgtgacgcgcgatagataacctcgacctcgccggtatggatattcacacgctcaatggtctcgccggtaaacgacgccccagaaggccgcacgtcaaacaccagccactggctgtcgggcgtccaggtattggtattggtgagcaggtgattacggggagcaaaggttatctgtttcatggcgcggtcctgatacaaaacggttcccgccatcatacttcacaaggacttcactttcagacaatagtcttttgccatcgtgatgaatgtgagtgaaaagatggaacatttcgacgtggcgattattggcctcggcccggcagggtcggcgttggcgcgaaagttagcaggcaaaatgcaggtgatcgcgctggataaaaagcaccagcatggtactgaaggtttcagcaaaccttgtggcggtctgctggcaccggacgcgcagcgatcttttattcgcgatggactgacgcttcctgtcgatgtcatcgccaacccgcagattttcagcgtcaaaaccgtcgacgtcgccgcatcgctcacgcgtaactaccagcgaagctatatcaatattaatcgccatgctttcgacttgtggatgaaatcgctgatccccgccagcgttgaggtttaccacgacagcctgtgtcaaaaaatctggcgtgaggatgataaatggcatgtcatttttcgcgcagacggctgggagcagcatattaccgcccgctatctggtcggtgccgatggtgccaactcgatggtgcggcgacatctctacccggatcatcagattcgtaaatatgtcgccatccagcagtggttcgcagagaaacatccggtgccgttctactcctgcatctttgataatgcgataactgactgttactcatggagtatcagcaaagacggttattttatctttggcggtgcctatccgatgaaagacggtcagacgcgtttcacggcgctgaaagagaaaatgagtgcctttcagttccagtttggtaaggcggtgaaaagcgaaaaatgcacggtgctgtttccctcacgctggcaggattttgtctgcggcaaggacaacgcctttctgattggcgaagcggcgggatttatcagcgccagctcgctggaggggattagctatgcgctggatagcgcagagattctgcgttcggtattactgaagctgccagagaagctcaataccgcttactggcgcgccactcgcaaactgcgtttaaaactcttcggcaagatagtaaaaagccgatgcctgaccgcaccggctttaagaaagtggattatgcgcagtggagtggcgcatattccacagttgaaagattatccaacgcgcttcacatcgcccaccagcaggatgtaagagagcgcgccaatcaacgcgacggcggagatataaaccagtgcaggtgcgaaaccgtaaccctgcgccaggtaccccaccaccagcggaacagtgatgccgcccagaccaccggcaaagttaaacacgccgccggttaaaccaatcaggcgcatcggtgccagagaagagaccagcgaccaggttatcgaagcaaaaccgttgccgaagaatgccagcgccatcaggcacataatcatcatcggatcgttggtgtagttcgcacccataatgcaggtggagatcagcaagccgcagataatcggcgttttacgcgcaaagcccagtgaaaagcccttacgtaccagcagatccgcgacccagccagagagcaggacgccaataaacgccgcgaggaatggcaccgtggtcataaaacctgctttcagcgccgtgattcctttttcctgggttaaatagttcgggaaccaggttaagaaaaaccacagtgtagaagccaccgcaaattgcccaagatagacaccgatcagtttacgatggaacaccagtttccagtctttggctgttaacggctgacgcgcctcttttttcaccggcgcatcgccatccaccagaccgccgccatcacgaatgtaatccagttcagctttgctgatgcctttggtcagacgcggcggctgataaaccttaaaccaaatcagcgaccagataatgccgataccaccggtgacaatgaacacccagtgccagctcaacatctcctgaatccagatcagcagcggagtcagaaacgccagaccgacaaactgaccagacgtataaaaaccaacggcagaagcacgttcatgttccgggaaccaactggttaccatccggttattggtcgggaacgcgggcgcttcgaaaataccggttatcgcgcgcagaccaattaatgacattaagcccgtggcaaagccctggaataacgtcgccactgaccagccaaatatcgcaataaaataagtcacgcgtgagcctacgcgatctaaaaaccaaccaccggggatctgacatagcgtataaagccaggcgaaggccgaaaatacatagcccatttgcgctttagtaataccaaactcttcctgaatatgggcagaagccacggccaggttagcgcggtcaacataacaaatgaccaccgtaataaagatcatcaccagcgtcagataacgccgacgccccggctttgctgcattaacgggaatatccatagcgagctttctccagattttgggcatagcgaagccgctcaccatgccctgtaatttacagagggttatatttttgtattgctgttttagtgcccgatgaggggcttacgtggcaggaattaccactctgctacgctgttatcttcatgacgccagagcggattacgccagtccggggcatttttactgaactcaataactttagcttcgtcgatttccacgcctaagcccggtttcgttaatggtttaaagaaaccgccgaccatgctgaagtcttctttgtttttcacaaagtcgagtaactccgcgcctttgttgtaatgaatgcccatactttgttcctgaaggacggcgttataggaaacaaagtcgatatgcaggcaagccgccagtgcaatcggtccgagcggacagtgcggcgcaagggtcacgtcataggcttctgccattccggcaattttgtagcattcggtaataccgcctgcgtgggagagatccggttgcagaatcgaaataccgcctgcctccagcacacgtttaaaatcgaagcgtgagaacatgcgctcacccgccgccagtggaatatgcgtttgtgccgccagtttcgggtagtattcggcctgttccgccagcaccggctcttcaataaacagcgggcgatacggctccagttctttaatcagcactttcgccatcggcgcgctgacgcgaccatggaaatcaagaccaaactcaatctgattgccaaaagcttcacgaatttgtgccacggtgttgactgccgcatctaccgcgcgggagttatcaattagccccagttcttcacaaccgttcagtttgaaggtatcgaagccgatttcgcgtagcgttttaatgccgtcgataacatccgccggacgatcgccgccgacccaactgtaggctttaattttgtcgcgaaccaggccgcccatcagttgccagaccggcgcattcagcactttgcctttgatatcccataacgcctggtcaatcccggcgatggcgctcatcagaatcggaccgccacgataaaatccggcgcgatacatcacttgccataagtcgttgatgcgtgacgggtcctgaccaatcaaatagtcactcagctcgtggactgccgcttccaccgtgcgagcgcggccttcaatcacgggctcgccccaaccgaccacgccttcatcggtttcaattttcaggaacatccagcggggaggtaaacgatacgtggtaattttggtgattttcattgcactgcctctcgatacgccttaacaaatgctgctgcctgctgcgcagtccgttctacggactgcccggcgcgatagagatcgctacctaagcccgcccctgcacaacctgcgtctatccactgcgccaggttttctggcgtcacaccgccaacggcaaagaccgcgatgtccggtggtaataccgcttttaatgctttgatgtattgcggaccaaaagccgatgacggaaatattttcagcgcctgcgcgcccgcttcgagcgcggtaaaggcttcggtcgccgtcgcgcagccggggcagacggtcatgccgtagcccaccgcacggcggatcacttcactatggatattgggcgtaacgatgagctgacagcccattctggcgagcgcatcgacctgttcaggtttcagtaccgtacctgcgccaatcaacgccttatcgccgtacgcatcaacgatggcgggaatgctctgctcccattgtggagaattcagcgggatttcaaccgcgtcgaacccggcgtcaatcaccgcgccaacatgtgccagtgcctcgtcgggcgtaatgccgcgcaaaatggcgatcagcgggagtttagtttgccactgcatgagcgatgctccttataccagcctgaaatgccgtgtcgcctgccaccgccgtcacatcgcaacccatcgcctgaaaggcttgctggtagcgcgcggtcagcgatgttccggcgacaagggtgatgacttgttgatgggccacatagtcgcgcatactggcgacctctgcgccaatcaacaaaccagagagaaattcgctgacctgttcgcggggaagtgttcccagcacatgcgaggcgcgaacttcaaaaagctgtggcaatacggcgggcgcattaaagccacgctcaagaccagccgcgaaagcatcggcagagttttcctgcggcggcaaacctgcgccaatcaatgagtgatttaacagtaaatgatgtaattcaccggtcatcacggtgcgaaaatcgttaatttgctggctatcggcctgcacccatttgcaatgcgtaccgggcatgacataaagagaggaaggagcgagagtgcgcgcgccgatcaattgtgtttcttcgccgcgcatcacattgtggttatcgtcatgagagacgcataatccgggaataatccagatattgtcgccagcagatgttaattgttcgccaatagacgagaaacgggctggaacggataaatacggcgcaactttccagccgacattgctgccgaccattcctgccattaccactggcgtattctcttcacgccagtcggtcgtcacttctgctaacaccgcagccggagattttccgttcaggcgcgtgacgcctgcttctgattgcctgctgtccaggcagtggtcgccctgataaagccaggcgcgcagattggtcgatccccagtcaattgcgatgtagcgagctgtcatgtgatttcctttaaccttcgtgtcgagctggcgatcatggtaagcgccgcctgctctgccgcatcgccgtcctgatgccttatcgcatcgaacagcgccttatgttcctggagcgtttgcggcatgttggcctcatcgcccatccaggttcgttcaaaaaccgcccgctgcagcgaactgatcgcaatgctcagttgctgtaacaccgggttatgcaccgactgcagcaccgcctcgtggtagcgaatatccgcttcgttaaacgcttcgcggtcctgattgttagcaatcatctcgttcagcgccgattcaatctgcgccagatcgctggaggtcgcgcgttctgctgcccaacgggcaatcgccggttccaccagatttcgcacttcgctcattgcactgataagccgtgggtcgtagtcgttttccagcacccattgcagtacgtcagtgtcgaggtaattccactggttacgcggagccacaaacgccccgcgataacgtttcatttcaatcagccgcttcgccatcagcgaacgaaatacctcacggatgatgttgcgcgaggttgcaaactcctcacagagttctgcctcagccggaagcggcgagcctggcacgtatttgccgtgaacgatctgtctacccagcgtaataacgatgcgatcggttttattgagagtcatggagagtccttgtgctctgtatgttcttctctactttaccccgatcgatgcataacgcggtaattttgtagtaccagcgtgatgacgttcgcgtttgctgcgcgcctaatgtagtacaaagttatattgttgtactacaatttagatcacaaaaagaacaatccataagaaaatgttctacgtcgggcaaaaatctgaaaagggagatcaggcgctaaactggggggaaagaagagtatgctttcaacggcttagtactcttgtttaaaggattaatcatgaagttgaatcttaagggatttttcaaagctgccagtttgtgttctttagcatttgcgttgaccggatgtatcacctggggattggtttccaatactgcaagccgtccacatgccgagcaatggcggtcagacacgattaagggtttatcgctggcagaagatagtaacggtacgaaaggctatgtttttgttggtgaatcgttggactatctgttgaccaccggcggcgatgaggtggttaacatgctgaacgatccggcaatccatggtgaaagaatcaccgtttctgataacgcgaaatttattttaagcagcagtaataagaatttctctggtgctattacgctctattacgactggaacaacgaagaagataaggcactggcaacacaatatggttttatttgtgatacccggcgttgtacatggatgctggacggtttgaaaggctcaatccaccagaaaaataaaaaagcggattactcaaacgtgatggttttccatcaaccctttacggtgggattttatgagtacaaagcaacagatggcgtcccgcacggcctcgttaatgcgctgctgccagtcactcttacgctggatatagtaacgtcaccactccagttcctgattttatgcacgaccagaaattgttaatcgctgcgggcaaacgcattcatgccgtttgcccgttcactgattaattcagcacatacttctcaatagcaaatgccacgccatcttcaaggttagatttggtgacaaagttcgccacttctttcaccgaaggaatagcgttatccatcgccacaccgacgcctgcatattcaatcattgcgatgtcgttttcctgatcgccaatcgccatgatttcttccggtttaatacctaacacgtcggccagtgatttcacacccgtacctttgttaacgcgtttatcgaggatttcgaggaagtacggcgcacttttcagcacggtgtatttttctttcacttcctgcggaatacgcgcaatggcctggtcgaggatggcgggttcatcaatcatcatcactttcaggaactgggtattggggtccattttctccgcttcgcagaacaccagcggaatggtggcaacgaaagattcatgcaccgtgtagtagctgatatctcggttggcggtgtacagcgtggtgcggtccagggcgtggaaatgagaaccgacttcgcgagagagtttttccaggaaacggtagtcgtcatagctgagagcggtttgcgccacggtgctaccatcagcggccttctgtaccagcgcgccgttataagtaatgcagtagtcgcccggctgttccatatgcagctctttcaggtaattgtgaacacctgcataagggcgacccgtcgttagcacgacattcacgccacgggcgcgagctgcggcaatcgcatttttaacggcgggtgaaatggtgtgatcgggcagcagaagggtgccatccatatcgatagcaatgagtttgatagccatgagttccccaggtagattggttcctgacccatgctaacgcgattccgctcaaaaatcagtacaacacccgagggaaaagggggatgcaacgcgcattgcgtgctccccttttgcttagcggaaaagtttccctttcagcagttccatgcctgcggaaagcagatcgttattggcttgtggtgacacttcaccttgcggtgagagcgcatcaataatcttcggcaattgttctgccagtaaactggaagctgtactggtatccacgccaagtttttgcccgagatcggacaccgcatttgtgccgagcgccgattccacttgctcgccgctaactgattgattgctctgttgattactcagccaggttgagagaatggcccctaagccgccactttgcagtttttccaacagcacttgaatgccgccctgttcctcaacccagctcaaaatggcctgatatttccccgcatcgcctttcagaaaggcaccgacaacgtcatcaaaaaggcccatgataatcacctgtaaagcgttacgtgttgactcaaaaagtatagttctgtgggatgataattgcggattgcaggaataaaaagggcggagatgatctccgcccttttcttatagcttcttgccggatgcggcgtgaacgccttatccggcctacaaaaacatgcaaattcaatatattgcaggagtctcgtaggcctgataagcgtagcgcatcaggcacgctcgcattgttaacgccattaaatatcgatattcgccgctttcagagcgttctcttcaataaacgcacggcgcggttcaacggcgtcgcccataagcgtagtgaacaactggtcggcagcaatcgcatctttaacggtaacgcgcagcatacgacggctttccgggtccatggtggtttcccacagctgttccgggttcatctcgcccagacctttataacgctggatggagaggccgcgacgggactctttcaccagccagtccagcgcctgctcgaagctggctaccggctgacgacgttcgccacgttcgataaatgcatcttcttccagcaagccacgcagtttctcacccagcgtgcagatacgacgatattcgccgccagtgataaattcgtgatccagcggatagtcagtatccacaccgtgggtacgcacgcgaacaatcggctcgaacaagttttgctcagcattggtgtggacatcaaacttccactggctgccgtgctgttctttgtcgttcagttcgctgaccagcgcgttcacccagcgggtaacggtctgctcatcagagagatcggcttccgtcagcgtcggctgatagataagctctttcagcattgctttcggataacgacgctccatgcggttgatcattttctgcgtcgcgttgtactcagacaccagtttctctaacgcttcgccagccagcgccggtgcactggcgttggtgtgcagcgttgcgccatccagcgcgatagagatctggtactgatccatcgcttcgtcgtctttaatgtactgttcctgcttacctttcttcactttgtacagcggcggctgagcgatgtagacgtgaccacgttcaacgatttccggcatctgacgatagaagaaggtcaacagcagcgtacgaatgtgcgagccgtcgacgtccgcatcggtcatgatgatgatgctgtgataacgcagtttgtccgggttgtactcgtcacgaccgataccacaaccaagcgcggtgataagcgtcgccacttcctgagaagagagcatcttatcgaagcgcgctttctcgacgttgaggattttacccttcagcggcagaatcgcctggttcttgcggttacgcccctgcttcgcagagccgcccgcggagtccccttccacaaggtacagttcggaaagcgccggatcgcgttcctggcagtctgccagtttgcccggcaggccagctaaatccagcgcacctttacggcgggtcatttcacgcgcgcgacgcgcagcttcacgggcacgggcagcatcgataattttgccgaccacgattttcgcgtcggttgggttttccagcaggtattccgccagcagttcgttcatctgctgttcaaccgccgatttcacctcagaagaaaccagtttgtctttggtctgtgaggagaatttcgggtccggcactttcacggaaacgaccgcaatcaggccttcacgcgcatcgtcaccggtggcgctgactttggcttttttgctgtagccttctttgtccatgtaggcgttcagggtgcgggtcatcgccgcacggaagcctgccaggtgagtaccgccgtcacgctgcggaatgttgttggtaaagcagtagatgttttcctggaagccatcgttccactgcaacgccacttcgacgccaataccgtctttttcggtggagaagtagaagatattcgggtggatcggcgttttgttcttgttcagatattcaacgaacgccttgatgccgccttcatagtggaagtggtcttctttgccgtcgcgcttgtcgcgcagacgaatggaaacgccggagttgaggaacgacaactcacgcagacgtttcgccagaatgtcatattcgaactcggtcacattggtgaaggtttcaaggcttggccagaaacgcaccatagtgccggttttttcagtctcgccggtaaccgccagcggggcctgcggtacaccgtgttcgtagatctgacggtgaattttaccctcgcgctggataaccagctccagtttttgcgacagggcgtttactaccgaaacaccaacgccgtgcagaccgccggacactttataggagttatcgtcaaatttaccgcctgcgtgcagaacggtcatgatcacttccgccgccgatacgccctcttccgggtgaataccggtcggaatgccgcgcccgtcatcctgtacagagacagagttatcggcgtgaatggtgacgataatttctttacagtgacccgcgagcgcttcgtcgatagcgttatctaccacctcgaataccatgtggtgcagaccggtgccgtcatccgtgtcgccgatatacatacccgggcgcttacgcaccgcatccagccctttcaggactttgatactggaggagtcataagaattcgacatcaacgtttctcgctcatttatacttgggttaatccgttattttacccttttccacggtaaacatcttcgaattttcgtccgacatgtctataacgtgttcagcactgatcgcgctgacaaagacctgtgattgcgtcgcttttaagcggctggcaagcagcccgcgacgctcatcatcaagctcagaggcaaaatcatctatcaggtagagacaccgccgcccgctttcacgggtgaggaactctccttgcgccagacgtaaggcgcacatcaacagcttaagctgcccacgcgataaggtatcttccaccggcgcaccgtcggcgcgaatgcgtaagtccgctttatgcgggccgtgcgcggtgtaggttagctggcgatcgcgttcaaaattacgttccagcacctcagcgtactctgtctctttctcccagccgcgctggaaagagaaagtcagagaaaactcagggagaaattgcttacaggtatcagccatatcggctgcgataccggcgctatactccgcgcgccaggtgctgatttgctccgccagcgggatcagttctttatcccacgggcgtagctgttcgtaacgagtcacctggcgcagcgccgcattgcgctgcttgagcaatcgcttgagattgctccaggcggtgaaaaatccgggttcgttgtgaaagcatccccagtcgaggaatgctcttctgtatttggggccgccgttgagtaaagtaaacccttctggcgttatcagctgcattggcatcaggtgcgccagctccgcgactttatgcccgtctgtaccgtcaatacggactttgctatcgccttgtttgtctttggttaaaccaatcgccgtctcgcgctcttcgccctgtaatcgcccgtggagaacaaacgcctcctgctcgtggcgaatgacgcgaccaatctgcaaactgcgaaacgcccgaccgtggccgagcgtatagatggcttccagcacgctggttttgccactgccgttggcacctaccagaaagttaaagccgggagataaggcgagatccgcggtttcaatgttgcggaaatcgcggatcaacaagcgggtgagggacattacagtctcattggcatgacaacataagccgcgctctggctggccgcatcttcaatctgcacgctggaaaccgaatcggtcagcatcatgcggacgttttcgcatttcagcgcgttgagaacatccagcacatagctgacgttgaagccgatttccatctccgcaccgctataggtaacgtcgaggatctcttccgcttcttcctgttctgggttgttggcggtgattttcagctggttttcgctgacatacagacgcacgccgcggaatttctcgttagagagaattgccgcacgagcaaacgcctgcttgagcagatcacagccagcttccagatgtttgtccgggttcttcggcagaacgcgacggtaatccgggaagcgaccatccaccagtttcgaggtgaagataaagtcgccaacgtgggcgcgaatgttgttgctgccaatctgcacgcgcagcggattgtcgccgccgtcgagcatacgcatcagttcaatcacgcctttacgcggcacgatcaccgaatggcttggcaaagattgaccaattggcattgaacagactgccagacggtggccgtcggtcgccacggtgcgcagttcttcaccttcggtttcaaacagcataccgtttaagtaatagcgaacgtcctgatgcgccatagaaaactgggtcgcttcaatcagacgcttcatcgtcgcctgcggcagggtaaattcgacttcgctctgccagtcatcgaggttcgggaaatctgccgctggcagggtagacagcgaaaaacggctacgcccggagcgcaccagcatccgctcaccttccagctgcacggcaatttccgcgccttcaggcagaccacggcagatatcaaagaatttgcgcgccggaacggtcgtcgcccctggttcgtgcggctgaaccagcgcaacgcgtgccaccatttccatctcgagatcagtaccggtcagcgacaacgtaccgtcagcaacctgtaacagcagattaccgagaatcggtagcgtaggacgaccacctaacggaccgctcacctgttgtagcggttttaataaatgctcacgttctacggtaaatttcataggtttacgatgacaatgttctgattaaattagaaaaatcttctttgatatcgtggctctcttcacgcaactgctcgatcttccggcaggcatgaagcaccgtcgtgtggtcacgaccaccaaaggcatcgccaatctccggcagactgtggttagtcagctctttcgccagcgccatcgccatctggcgcggacgggccaccgagcgggatcgacgcttggaaaggagatccgcgactttgatcttgtagtactccgccaccgtcttctgaatattgtcgatggtgaccagtttttcctgcaatgccagcaagtcgcgcagcgcctcacgcacgaagtcgatggtgatcgcccgtccggtaaagttggcattggcaatgacgcggttcagcgcgccttccaactcacgtacgttagatcgtagacgcttggcgataaaaaacgccacttcgcccggcaaacgaatgtcgttttcgtcggcctttttcatcaggatcgccacgcgggtttccagctctggcggttcgatcgccacagtcagtccccagccgaagcgggatttcaaacgatcttcaacgccgttgatctctttcggatagcgatcggaggtgagaatgatctgttgattaccttccagcagggcgttgaaggtgtggaaaaactcttcctgagatcgttctttattagcaaaaaactgaatatcgtcgatcagcagtgcatctacggaacggtagtagcgtttaaactcttcgatcgcgttgttttgcagagctttaaccatgtcctgaacaaagcgctcggagtgcatataaaccactttggcattcggcttgcgcgccataatgccgttacccaccgcatgcagcaggtgagttttacccaaacccgtgccgccataaaggaacaacgggttataagcaccgccagggttatctgccacctggcgagccgccgcgcgcgccagttggttagatttaccttcaacgaagttatcaaacgtgtgtttgacgtttacgttagaacgataggtcggttctgccggagccgggacgttatcccaacccgagcgcgtagaaggcgcagcacgttgcggctgcgtttgcgccacctgtgcaggggccgcgacgttgctcgtcactgccgcttgtggcgtttgcgtcaccggtttggtgccgacttcaaaacgcagctgtggggcatccgctccgcagaaactggttagcagtccattgatattattaaggtacttgtcccgtacccaatcgaggacaaaacggtttggcgcgtacagggccagcgtgttatcgctcagttccgcctgcaatgggcgtatccacatactgaattctgtggctggtaactcatcctgcaatcgggcaagacactgctgccaaagcgaaagtgacacggcggactccactcgaacaaaagtcgataatgactaaggctgaaacattcatgattgttgacgtacgtcgaaaagaccctgcatgagggtgatgcacgaaccgctgtctgcggttatatgcccgatcaagatcctgcaaaacgatcgggaccgcggatcatagcctaaactgcgcaagagatcttctgtttctcacagattttcccgatttatccacaggatgatccagaactcgctaagtgtaaacgatcctgccgcgggccgggcacgatttacgccgcatattggaaaatttaatgaccatagacaaaaattggcttaatcgatctaataaagatccaggacgatccttgcgctttacccgtcagcccgtataatcctccacccggcgcgccatgctggttttcactggtgtgaggccgtacgttctccccgcgaaaaggtgcggaaaagcgcggtaaataaggaaagagaattgactccggagtgtacaattattacaatccggcctctttaatcacccatggcttcggtgtccatcgtttcatttttcggcggatatccaataaagccattgaatttattcaagtttaggtagaaatcgccatgaaacgcacttttcaaccgtctgtactgaagcgcaaccgttctcacggcttccgtgctcgtatggctactaaaaatggtcgtcaggttctggcacgtcgtcgtgctaaaggccgcgctcgtctgaccgtttctaagtaataaagctaacccctgagtggttaagctcgcatttcccagggagttacgcttgttaactcccagtcaattcacattcgtcttccagcagccacaacgggctggcacgccgcaaattaccattctcggccgcctgaattcgctggggcatccccgtatcggtcttacagtcgccaagaaaaacgttcgacgcgcccatgaacgcaatcggattaaacgtctgacgcgtgaaagcttccgtctgcgccaacatgaactcccggctatggatttcgtggtggtggcgaaaaaaggggttgccgacctcgataaccgtgctctctcggaagcgttggaaaaattatggcgccgccactgtcgcctggctcgcgggtcctgatagccctcattcgggtctatcaacgcctgattagtccgctactcgggccgcattgtcgtttcactccaacctgttcaagctacggaattgaggcattgcgcaggtttggagtgataaaaggcagttggttgacggtgaaacgcgtattaaaatgccaccctttacaccctggtggtgacgatcccgtcccgcccggaccatttgataccagagaacactaacgatggattcgcaacgcaatcttttagtcatcgctttgctgttcgtgtctttcatgatctggcaagcctgggagcaggataaaaacccgcaacctcaggcccaacagaccacgcagacaacgaccaccgcagcgggtagcgccgccgaccagggcgtaccggccagtggccaggggaaactgatctcggttaagaccgacgtgcttgatctgaccatcaacacccgtggtggtgatgttgagcaagccctgctgcctgcttacccgaaagagctgaactctacccagccgttccagctgctggaaacttcaccgcagtttatttatcaggcacagagcggtctgaccggtcgtgatggcccggataacccggctaacggcccgcgtccgctgtataacgttgaaaaagacgcttatgtgctggctgaaggtcaaaacgaactgcaggtgccgatgacgtataccgacgcggcaggcaacacgtttaccaaaacgtttgtcctgaaacgtggtgattacgctgtcaacgtcaactacaacgtgcagaacgctggcgagaaaccgctggaaatctccacctttggtcagttgaagcaatccatcactctgccaccgcatctcgataccggaagcagcaacttcgcactgcacaccttccgtggtgcggcgtactccacgcctgacgagaagtacgagaaatacaagttcgataccattgccgataacgaaaacctgaacatctcttcgaaaggtggttgggtggcaatgctgcaacagtatttcgcgacggcgtggatcccgcataacgacggtaccaacaacttctataccgctaatctgggtaacggcatcgccgctatcggctataaatctcagccggtactggttcagcctggtcagactggcgcgatgaacagcaccctgtgggttggcccggaaattcaggacaaaatggcagctgttgctccgcacctggatctgaccgttgattacggttggttgtggttcatctctcagccactgttcaaactgctgaaatggatccatagctttgtgggtaactggggcttctccattatcatcatcacctttatcgttcgtggcatcatgtacccgctgaccaaagcgcagtacacctccatggcgaagatgcgtatgctgcagccgaagattcaggcaatgcgtgagcgtctgggcgatgacaaacagcgcataagccaggaaatgatggcgctgtacaaagctgagaaggttaacccgctgggcggctgcttcccgctgctgatccagatgccaatcttcctggcgttgtactacatgctgatgggttccgttgaactgcgtcaggcaccgtttgcactgtggatccacgacctgtctgcacaggacccgtactacatcctgccgatcctgatgggcgtaacgatgttcttcattcagaagatgtcgccgaccactgtgaccgacccgatgcagcagaagatcatgacctttatgccggtcatcttcactgtgttcttcctgtggttcccgtcaggtctggtgctgtactatatcgtcagcaacctggtaaccattattcagcagcagctgatttaccgtggtctggaaaaacgtggcttgcatagccgcgagaagaaaaaatcctgattcggtgagttttcgctaaaataagggcggtcagttgaccgccttttttcttttcgtaggacggataagcaccgcacatccgccacacaaagcaacaggaacatcatgagcgataatgacactatcgtagcccaggccacgcctccgggacgtggcggcgttggcatcctgcgcatctccggcctcaaagcccgtgaagttgccgaaaccgtgctgggtaaactgcctaagccacgctacgccgattatcttccgtttaaagacgccgatggcagcgtgctcgatcaggggattgcgctatggttccctggcccgaactcgttcaccggcgaagatgtgctggaactgcaaggtcatggcggtcctgtgatcctcgacctgctgttaaaacgcattctgaccattcccggcctgcggattgcccgccctggtgagttttccgaacgcgcatttctgaacgataaactcgacttagcccaggccgaggcgattgcggatcttatcgacgccagctcggaacaggcggcccgttcggcgctaaactcgctgcaaggcgcgttctccgcacgggtcaaccatctggtggaagccctcacccacttgcgcatttacgtcgaagcggcaattgatttcccggatgaagagatcgatttcctctccgacggcaaaattgaagcccagctcaatgacgtaattgccgatctcgacgcggtacgcgccgaagctcgtcagggtagtttgttgcgcgaagggatgaaagtggtgattgccggacgtcctaacgccggtaaatcgagcctgctgaacgcgctggcgggccgtgaagcagcaatcgtaaccgatatcgccggaaccacgcgtgacgtgctgcgtgagcatatccacattgacggaatgccgttgcatatcatcgataccgccgggctacgtgaagccagtgacgaagttgaacgtattggtatcgagcgcgcatggcaggaaattgaacaggcagaccgcgtgctgtttatggtcgatggcaccacgacagacgccgttgatccggcagagatctggccggaatttatcgcccgtctgccagcgaaactgccgatcaccgtggtgcgcaataaagccgatatcaccggcgaaacgttggggatgagcgaagtgaacggtcacgcgttaattcgtctttcggcgcggactggcgaaggcgtggatgtgctgcgtaaccatctcaaacagagcatgggctttgacaccaatatggaaggcggcttcctggcgcgtcgtcgtcacctacaggcgctggaacaggcggcagagcatttgcagcaaggtaaagcgcaactgttaggtgcctgggcgggtgaactgctggcggaagagttgcgcctggcgcagcagaacttaagcgagatcaccggggaatttacttcagacgacctactggggcggattttctccagcttctgtatcggtaagtaaccgcgcttgcgaagccgcattctgactgtcagatgcggcttcgcttcattgttagcactcctgttattcctcaacccttttttaaacattaaaattcttacgtaatttataatctttaaaaaagatatttaatattgcgtcccgaacgattgtgattcgattcacatttaaacaatttcagaatagacaaattccttgagtattatactgtagcctcgtgtctttcgaggataagtgcattatgaatatcttacatatatgtgtgacctcaaaatggtttaatattgacaacaagattgtcgatcaccgcccttgatttgcccttctgtagccatcaccagagccaaaccgattagattcaatgtgatctatttgtttgctatatcttaattttgccttttacaaaggccatctctcgtttatttacttgttttagtaaatgatggtgcttgcatatatatctggcgaattaatggatactgcaaatgtaatattcacagggatcactgtaattaaaataaatgaaggattatgtaatggaaaactttaaacatctccctgaaccgttccgcattcgtgttattgagccagtaaaacgtaccactcgcgcttatcgtgaagaggcaattattaaatccggtatgaacccgttcctgctggatagcgaagatgtgtttatcgatttactgaccgacagcggcaccggggcggtgacgcagagtatgcaggccgcgatgatgcgcggcgacgaagcttacagcggcagccgcagctactacgcgttagccgagtcagtgaaaaatatctttggttatcaatacactattccgactcaccagggccgtggtgcagagcaaatctatattccggtactgattaaaaaacgcgagcaggaaaaaggcctggatcgcagcaaaatggtggcgttctctaactatttctttgataccacgcagggccatagccagattaacggctgtaccgtgcgtaacgtctatatcaaagaagccttcgatactggcgtgcgttacgactttaaaggcaactttgaccttgagggattagaacgcggtattgaagaagttggcccgaataacgtgccgtatatcgttgcaaccatcaccagtaactccgcaggtggtcagccggtttcactggcaaacttaaaagcgatgtacagcatcgcgaagaaatacgatattccggtggtcatggactccgcgcgctttgccgaaaacgcctatttcatcaagcagcgtgaagcagaatacaaagactggaccatcgagcagatcacccgcgaaacctacaaatatgccgatatgctggcgatgtccgccaagaaagatgcgatggtgccgatgggcgggctgctgtgcatgaaagacgacagcttctttgatgtgtataccgaatgcagaaccctttgcgtggtgcaggaaggcttcccgacatatggcggcctggaaggcggcgctatggagcgtctggcggtaggtctgtatgacggcatgaatctggactggctggcttatcgtatcgcgcaggtgcagtatctggtcgatggtctggaagagattggcgttgtctgtcagcaggcgggcggtcacgcggcattcgttgatgcaggtaaactgttgccgcatatcccggcagatcagttcccggcacaggcgctggcctgcgagctgtataaagtcgccggtatccgtgcggtagaaattggctctttcctgttaggccgcgatccgaaaaccggtaaacaactgccatgcccggctgaactgctgcgtttaaccattccgcgcgcaacatatactcaaacacatatggacttcattattgaagcctttaaacatgtgaaagagaacgcggcgaatattaaagggttaacctttacctacgaaccgaaagtattgcgtcacttcaccgcaaaactgaaagaagtttaattaaaacactcagagtggctataaggatgttagccactctattaccctacatcctcaataacaaaaatagccttcctctaaaggtggcatcatgactgatcaatcagaaaaaaaacactctgcattttggggtgttatggttatagccggtacagtaattggcggtgggatgtttgctttacctgttgaccttgccggagcctggtttttttggggcgcttttattcttattatcgcctggttttcaatgttacattcagggctattattattagaagcaaacttaaattatcccgtcggttccagttttaacaccatcaccaaagatttaatcggtaacacctggaacattatcagcggtattaccgttgccttcgttctctatatcctcacttatgcctatatctctgctaatggtgcgatcattagtgaaacgatatcaatgaatttgggctatcacgctaatccacgtattgtcgggatctgcactgccattttcgttgccagcgtattgtggataagttcgttagccgccagtcgtattacctcattgttccttgggctgaagattatctcctttgtaattgtttttggttctttcttcttccaggtcgattactccattctgcgcgattccaccagcaccactgcggggacgtcttacttcccgtatatctttatggctttgccggtgtgtctggcgtcatttggtttccacggcaatattcccagcctgattatttgctatggcaaaaagaaagacaaactaatcaaaagcgtggtcttcggttcgctgctggcgctggtgatttatctcttctggctctattgcacgatggggaatatcccgcgagaaagctttaaggcgataatctcctcaggcggcaacgttgattcgctggtgaaatcgttcctcggcaccaaacagcacgggattatcgagttttgcctgctggtgttctccaacttagctgttgccagttcgttctttggtgtcacgctggggttgttcgattatctggcggatctgtttaagattgataactcccacggcgggcgtttcaaaaccgtgctgttaaccttcctgccacctgctttgttgtatctgatcttcccgaacggcttcatttacgggatcggcggtgccggactgtgtgccaccatctgggcggtaataattcctgctgtactggcaatcaaagcccgcaagaagtttcccaatcagatgttcacggtctggggcggcaatcttattccggcgattgtcattctctttggcataaccgtaattttatgctggttcggtaacgtctttaacgtgttacctaaatttggctaaatccttcaggaagccagccattcgctggcttcttgcctgtcaggaaatcacttatgtccaaatggcaactcgcctgattctccttcaccacgtatgctttgcgtcaccttactatcaggacgctttagcccatgtcccgctttttgatttgtagttttgccctggttttactttatcccgcagggattgatatgtacctcgttggtttaccgcgcatcgccgccgatctcaatgccagcgaagcgcagttgcatattgcgttctccgtttatctggcggggatggcggctgcgatgttatttgccggtaaagtggccgatcgttcagggagaaagcctgtcgccatacccggcgcggcgctatttattatcgcctcggtgttctgttcactggctgaaaccagcgcgttatttcttgcagggcgatttctacagggactgggcgcgggctgttgttacgtagtggcgtttgccattttgcgcgacacgctggatgatcgacgtcgggctaaagtgctgtcgttactcaacggcattacctgcatcattccggtgttagcgccagtgctcggacatctgattatgcttaacttcccatggcagagtctgttctggacgatggcaataatgggtgtcgcggtactgatgttgtctttgtttattttaaaagaaacgcgccctgcggcccccgcagcttcggacaaaccacgagaaaatagcgagtcactgcttaaccggtttttcctcagccgtgttgttatcaccaccctcagcgtttcggtgatcctcaccttcgtcaacacgtcgccagtattgctgatggaaatcatgggttttgagcgcggagaatacgccaccattatggcgttgaccgctggcgtcagcatgaccgtttcattctccacgccgtttgcgctgggaatttttaagccacgtacgttgatgatcacctcacaggtgttattcctggcggcggggatcacccttgccgtttcaccttcccatgcggtttcgctgtttggtatcacgctgatttgcgccggtttctcggtaggttttggtgtggcgatgagtcaggcgttagggccgttttcattacgcgcgggcgtagccagctcgaccttaggtattgcgcaagtttgcggttcgtcactgtggatttggctggcggcggtggttggtatcggcgcatggaatatgctgatcgggattctgattgcctgtagcatagtaagcctgttgctgattatgttcgtcgcgcctggacgcccggttgccgctcatgaagaaatccatcaccacgcttgatctcaatctgctgctctgtctgcaactgctgatgcaggagcgcagcgtgaccaaagcggcgaagcggatgaacgtgaccccttcggcggtgagtaagtcgctggcaaagttaagagcgtggtttgacgacccgctctttgtgaactcaccgctgggcctgtctcccacaccgctaatggtcagcatggagcaaaatctggcggaatggatgcaaatgagcaatcagttgctggacaaaccactccacgaaacgccgcgcggtcttaagttcgaactggcggcggaatcgccgctgatgatgatcatgcttaatgcgctgtcgaaacggatctaccaacgatacccgcaggcgaccatcaaattacgtaactgggattacgattccttagatgccattactcgtggtgaagtggatattggtttttccggtcgcgaaagtcatccccgttcgcgggagctgttaagctcgctaccgttagccattgattatgaagtgctgtttagtgatgtgccctgcgtctggttacgcaaagatcatccggcactgcatgaagcatggaatctggacacctttttacgttatccgcatatcagcatttgctgggaacagagcgatacctgggcgctggacaatgtgttacaggagctggggcgcgaacgcacgattgctatgagcctgccggaattcgagcagtcactgtttatggcagcacagcccgacaatctgctactggcgaccgcgccgcgctactgccagtactacaatcaactccaccaactgccgttggttgctcttcctctcccgtttgatgaaagccagcaaaaaaagctggaagtcccttttacccttctgtggcataaacggaacagccgtaatccgaagatcgtctggttacgggaaaccattaaaaatctttacgcgtcgatggcataaccgaatcgtatgaaacgcgacccaatttcacaatgaaatgtaaaaaagttgtaataaacttatctgaatcgaacttttagccgctttagtctgtccatcattccagtaaatgattactcttgtattcataatggaccattaagcatggagcgaaaaatggcgactcactttgcccgagggattttaacggaaggacatctgatttctgttcgtctcccctcccagtgtcatcaagaagcccgaaacattccccctcatcgtcaaagccgttttctggcgtccagaggtttactcgcagaactgatgttcatgctgtatggcattggcgaattgccggaaatcgtcaccctgccgaaaggaaaaccggttttcagcgataaaaatttgccttcgttttctgtttcctatgccgggaatatggtcggcgtggcgttaacaaccgaaggtgaatgtggcctcgatatggaactacagcgtgcgacacgcgggtttcatagcccacacgcgcccgataaccacaccttttccagcaatgaatcgctatggatcagtaaacaaaacgatcctaacgaagcgcgggcgcagctcatcacgctgcgccgaagcgtgctaaaactaaccggtgatgttttgaatgacgatccgcgcgatctgcaactactgcccattgccggacgcctgaaatgtgctcatgtaaatcatgtagaagcgttatgcgacgcggaggacgtgctggtgtggtccgtggcggtcacgcccacgattgaaaagctcagtgtctgggagttagatggcaaacatggctggaaaagcctgcccgatattcacagcctcgccaacaatcctaccagccggatgatgcgttttgcccagctctctaccgtgaaggctttttcgccaaattgatagacaaccacaggagtcatcatgtctgaaaaattgcaggtggttacgttactggggagcctgcgcaaaggctcatttaatggcatggttgcacgtaccctgccgaaaattgctccggcgagcatggaaatcaatgcgttaccttccattgccgacattcccctgtatgacgctgacgtacagcaggaagacggttttccagcaacagttgaagctctggcggaacagatccgtcaggctgacggtgtggtaatcgtcacgccggaatataactactcggtaccgggtgggctgaaaaatgccatcgactggctttcccgcctgccggatcaaccgctggcaggtaaaccggtattgattcagaccagctcaatgggcgtgattggcggcgcgcgctgtcagtatcacctgcgccagattctggttttcctcgatacaatggtgatgaacaagccagaatttattggcggcgtgattcagaacaaagttgatccgcaaaccggggaagtgattgatcagggtacgctggaccacctgaccgggcaattgaccgcatttggtgagtttattcagcgagttaagatctaaataaaaacccgccagcaatcatgcatggcgggtttttaacgcgctatcgattttagtgagcgtcgataaagacaatcttcaggataaacagcagcgcaacgatgattacgcacgggctaaggtcacgcagacgtccggtaccaatcttcatcacgcagtaggagataaagcccagcgcgataccttcagtaatcgagaagctgaacggcatcatcacagcggtaataaacgccggaacagattcagtaagatcctgccagttcacgcgagcaagacttgaggtcatcaacacgccaacgtaaatcagcgcaccagctgcagcgtagcctggcaccatccccgccagcggcgacaggaagataaccagcaggaacagcagaccaacaaccactgccgtcagaccggtacgaccgccaacggaaacgccggaagaagactcgatatacgccgtaacagaagaagtcccgataaacgaaccggtcacggaagagatgctgtcgacatacagtgcctgcttcatgcgcgggaatttacctttttcatccgccagtcctgctttatcggtcacgccaatcagtgtaccggaggagtcaaacaggttgaccagcatgaaagagaaaatcacccctgccagcccgaggttaaacgacccggctaaatctacatgacccacgacagtcattacgctcggcggcgcagaaacgatgccattgtagtggacatcacccagcatccagcccagcagcgtcgtcaccacgatggaaaccagcaccgccgcgtgaatgttgcgtgaggccagaatagcaatgatgaagaagccgaggatccccagcagtacgctgtgagaagtcagattaccgatgctcaccagcgtttccgggttagcgacaatcacacctgcattcttcagtcccatcatgccaataaacaggccgataccgctggtaatgcccacacgcagactcaccggaatgttggctatcatccagtagcgaacgcggaaaatcgtcagtaacagcagaccaatcgcgccccagaagattgcgcccatcccgacctgccacggcaagcccatcgcctgcacaaccacaaaagcgaagaacgcattcaggcccattgccggtgccagtgcaactggcaggttagcaaacagccccatcataatactgccgaatgcagcaatcagacaggtcgtgacgaagacggcgctggtatccatgccagcaacgccaagaatttgcgggttaacaaaaacgatgtaaaccatcgtcaggaaggtggtaaaaccggcgatcacttcggtccgtgccgtcgtgccatgttcgcgcagtttaaacacgcgttccagcatcccctggccagaagcctgggttgtgtgttgttgactcattatctatttccgaacaaggagggaaaatccgtcgctatcgtataccaaaatgagacaatatggacggctgaatataactttttttcattgtatttgcttatacggcaacgattgcgtcatgcgaattggcatgacgaaaacgttaaactaacgataaaggaaagacatgtcccagatagaagcggtatttttcgactgcgacggtacgctggtcgatagcgaggtcatttgctctcgcgcctatgtcacgatgttcagggaatttggcattcacgttgacctggaagagatttttacccgttttaaaggcgtaaaactctacgaaatcatcgacatcatcagtaaagaacagggcgtgacgatggtccaggccgatgccgagcacgtttaccgcgcagaagtagcacgtctgtttgataccgaacttgaggacatcgcaggagcgaacgaattgctggcaagcattaacgtgccgatgtgcgtcgtctctaacggtccggtcagcaaaatgcagcattcgcttggtaagctcaacatgctgcactacttcccggaaaaactgttcagcggctatgatatccagcgttggaagcccgatccggcattaatgttccatgcggcaaaagcgatgaatgtgaacgttgaaaactgcattctggtcgatgactccagcgcaggtgcgcaatcagggatagatgccggaatggaagtgttttacttctgcgctgacccgcacaataaaccgatcgttcacccgaaagtcaccacctttacccatctttcgcaattaccggaactgtggaaggcgcgtggttgggatattacggcatagttattcacactcccttcacttactccacttaaattggcacgcaaaggtaagtaaagggagtttgatatgtctgtttcacgtcgggtaattcatcacggactgtattttgcggttttagggccgttaattggtgttctgtttcttgtcctctacatattcttcgcaaaagaaccgctgattcttttggtaataatacaggtacttccattgtttctcttaatgtcgataactacgggagctattcctgcaatgttaactggcgtaatggtcgcctgtctgccggaaaagatcgggtcacagaaacgttatcgttgtctggttggcggcataggtggagtcgttatcaccgagatctattgcgctgttatcgtacatattaaggatatggcttcctcagcgttgtttgaaaacattctttctggtgaaaatctcgttgtccgcatcatcccagcattgctggcaggcgtagtgatgagcagaatcattacacatctacccggattggatatttcatgtcctgaaacagactctttaagctaagcggaatgctttatctatttgtcattaaatgttggagaacaggccggagcgtaattcacacatccggccttatttttaagcttaaccgagcgctaattctgcggcagcggctttatcagcgattaccatcagcgaaggatgcagctgcaacacggaagctggaacatcttcggtaaccggaccttgcagaacatttttcagtgcctgcgctttacctgcgccactgacaattatcagcaagtttttcgccgccatgatgcttttcggccccatcgtcacgtagctgtcaggcactaatgaaaagtcgccgcccaactcgccatgcgccacaatatcaaccatctctccctggatcgggaactccacggtttgctcatggaaatgggtcgtatttggcagattgccacaaaaatgaccatctacacctaatcccaacaccaccaaatccaggccgccttcacgcgccagtttctgatcatgctcgcggtagttatcaatagtgagcttctggatattctcttctttgatccccgcaggggtgaaaaacagattacgcagattggtaatcgttacgccttctccctctttgccgcgaaatggaatttcatcgaaattatagaaatagcagttatcgtaccagggcttacctttaaccagagtgatgagatattcgtacatgcctttgggcgtgctcccggcggtaattgccaggttaacacgacgcgtcttcgacatataaccaagcagatggtgtgccgcgacacggctcatttcctggtaatcttcggtaatgattaatttcatcttaatgccttatattatttgaataatttctgtacgaaggctgcataggcaggccgccagacatccatttcatggttcagacctggatattcctggtaatcaaacttaatttttttctgctcaagctcagttttcagcccggcgatatccttgccggttacaacatctttatccccaacaaccacagtaaaattacgtagttgctggttaatagctgccggctcgttcagccgggcagcgaccccttcatctggtacggtcgtcgtggtaacaccactgaatgtggccagccagccaaagctttccagatgattcattcccgataccagtgcctgatacccaccttgtgaaagccctgccagtgcgcgaccatcggcatctttacggacattaaaacgcttgctaatcagcgggataatatcgttcatcagttcgcgatctgccgctttagcatttaacggataaaagactttacgtctctcctgaggaacgaaatcttcgggaataatgcccttcgcatcggtttcggtatccgggatcaccaccaacatcggtttaattttcccttcagccagcaggttatccatgatttgcgggatacgcccctgatcaatagcggaacgtccggtatcaccaaagccatgatagaaatagagcactggcaaaggctcgcctatgccggtgtatcctggcggggtccagacatacatctgacgttcggattgcaatgcgttggagtggtaagttatggcgatcaaatcaccatgcacaacagaacgtgtatccagataactgcccggtaccagaatcatactggagttaacctgacgctgaggcttagtcattgccgtgcctgtatcaatgctgcgtacaccatcaacattgaaaaaatactcgtacagattgcctttcaggacaggcgtgcgccacgaccagactcccgcttcatctttggtcatcgggtgaatattgtccggaaccggaacacccaccactacggagacattttttgccccaggggcaaagtagcgaaaggtcacgctgttatcggtattgacctgagtcacatactgtttcaccggaatagtgggtgccgggctggctggcatatccgctgctatggcccattgagcagaaataccgctggcaatagccagcgttaaagcagcaatttttatattcatcgtaatattccttttattaagttccattaccaccagatttcagcctgggcaccgacagcaaactggtcgtctttattgtcttcaaaggtgaagccatccagttcgttttccagagctttgatatatgtagcgtagaaacgaatttccgggcgcgaggtcaacatactggtattgactttaaaggtatggaagagcgtggttttataaccagactcattatatttattgctattcgcatctttgttttgctgggtgaaatagcccagttcaacacctgtctggttatattggtcccaaatataggccgggcgaacaaccgcacgaatagattcgaaatcagaatgtgcgcctgtttcgtagctataaatatcgttaccgaaggagtaaacaatcgcgttagccacaatgaaatgatcgccgatataagcttcgccctgcgaagtcagacgaactgcagttccgcctgtgtgatcaccataataacgaccattaaaggtagtaaatggacttgcaccagcataacgaccaaagttactggcgatagagttattcgcaaccaggaaggagaattcgttgaagccacccttatcaaatttctgcgttaaagatgtaccaaacatccaggtatctttccagtcataatacccgttattatcctgattatctttttccgatgcgctttcatttgctgagacataacgaccgctcaccattaaggtggctttatcccataacgggatatctttatagcgtaaatcaatggtattggtattaatctgctgtttgttttgcaggctgcgatcgtaatcatcgacatcttcacgaaccagcgcgatatcaattttacccggaccgactttccagttttccagacctacacctgcggcagcatcggtacgctgcgttttccagtcaagcatctggatttcaattttcggcgcaccgtgtttacccacccagaaatcagcctctggcgcaaagggcaggaaacctttggtggtaacgtacatatcagagaactgcataaagttctcaccaccggcgttatcgccaaaccagccagtagagtactgctgaccaacgttaccatccatcatcacgatggcatcaacccgtttgccgttttcgttgtagacacgttgttttaactgcaaatcaaaccagccggagtattcgttaccaaagcggcccagagaaccaattgcccatgatttaggtgaaccatgagaggctgttccccaaccagaacggtagtagccgttgtaactaaagccgatttcatctttcacaaatttactgaaatctttcagagtcatggaagaataaatcgagcctgtctcactggcatttttctcttcatttttaaccagtacagcatcaggctttgcggcacgactggtcgggaatggattggcggcatacccttgatcattcgtacttacgctacgattcaccgtcgctggcgtatactttttcttctcttcatctttatattttttcagttcgctttgcgtttctcttaacgccttttctaatagctcaaggcgttgttccactgttaatgattcagccaatgattgtgcggaaaaggctaacggtgccattaataagatggcagaggtaataatatttcgtctaaacataatatccctttatggtgcaaagaaagaattaatgaatcgcatccagactgttctgaatgcgacgataattaaggtgctttattggttatttttttaatgatagcccccgagttttgatcacttctgcataccatccgaagcttttcttgcgcgttcttgtgaggcttccttcaccattatcatcacgatccacataaataaagccgtagcgcttagacatttgtgaatgagatgcactgactaaatcaattggcccccaactggtgtaccccataatatccacaccatcggcaatcgcttcatttacctgtaccaggtgatcgtttaaataggcaattcgataatcgtcctgtatcgaaccatccacttcaacgctgtcttttgcgcctaatccgttctcgacaataaataacggtttttgataacgatcccaaagcgtatttaacagaatccgtaatccaaccggatcaatttgccacccccactctgaaattttcagatgcggatttgggatcatattcagtatgttgccctgcgcatttttattaatgctttcgtcgtgggaaacacaaccggtcatgtaataactaaaagagatgaaatctacggtatgttttaaatcttctgcgtcactttcagtcatctcaatggtgatattgtggtcgcggaagaaacgctgcatatagccgggatactgaccacgcgcctgaacatcaccaaagaacatccagcgccggttctcttccatggcctgcaacatatcctgtggctggcaggtgagggggtaaaccagcccaccgagaagcatattgccaattttcgcttcggggatcaggctatgacaggctttaactgcccgcgcactggcaaccagttgatgatggatcgcctgataaacttccgcctcgccactctcttctgccagccccacgcccgtgaatggcgcgtgtaatgacatgttgatttcattaaatgtcagccataacgcaactttatgttggtagcgggtaaagaccgtgcgtgcgtaatgctcgaagtgatcgatgaccgcccgattagcccaaccgccgtagtttttcaccagcccatatggcatttcgtaatgggataacgttaccagcggcttgatccccgcctgcgccatttcatcaaacagccgctcgtaaaatgctaaccccgcttcattcggttcggcttcatcgccctgaggaaaaattcgcgcccaggcaatggaaatacgcagacaggtgaagcccatctcggcaaataacgcgatatcttccgggtaacggtgataaaaatcgatggcgacatctttgatattctctttccccaggatgcgcggttccatttttcccattacgccatgaggctgtaaatctgaggtcgtgatccctttgccatcttcctgccaggcgccttccatctgattggcagctgttgcaccaccccaaagaaatgtttctggaaatgctttcataattaactccttttatcgttagcgaatgatggataacagcggctcaccagcgtttatctgcgccgtgccgtggggtaatacgtccgtaaaatcatcgctattactgattaataccggcgtcgtcagatcaaatccggcctcgcgaatagcagggatatcaaaagaaatcagccgatcgcctgtattgaccttgtcacccacgttgacgtgagcggaaaagaatttgccgtccagttttacggtgtcgataccgacatgaatcaggatctccacgccatcatctgactcaatgccgatggcatgtaatgtggcgaacaacgaagcaattcgacccgccaccggagaacgcacttcaccaacagagggcagaatggcaatacctttacccaacaggccgctggcaaacgtggtatcagcgacgtgaatgagcggcacaatctctcccgtcatcggtgaacagataccgccctgctcaggtgtaataacctctggtgttttctcttgctgggcaacttgcgctgactgactcttagcggtgatgaaatgaaacatcaccgtaccgacaaatgcgcaaccgatggcaatgacaccgccaataacgctggcccatacggtgaaatcaatccccgttgacgggatggtttgcatgaaggtgaaaatacctggcaaaccaaaggagtaaactttcgtttgcgcgtagccaatgatggtggcccccaatgccccacttatgcaggcgataacgaaggggtacttacgcggcagattgacgccatataccgctggttcggtgataccaaacagacctgtcaacgccgctgatcccgccaccacttttttctgtgcatcgcgttcgcagaggaagacgccgagcgccgccccgacttgcgccataatggcgggccttaacagcgggatcatggtgtcgtagcccagcacggtgaagttattgataattaaaggtatcaaaccccaatgcagaccgaacatcacaaagatttgccagaagccgcccattaccgcgcctgcaaatgcaggaaccgcctgataaagccagagataaccggcagcaatcagttcacttatccaggttgatagcggccccaccagcagaaatgtgatgggcgtgatgaccatcagacatagcaagggtgtgaagaaatttttgattgccgaaggtaaccacgcattaagtcggcgttccagaatgctgcacaaccaggcagaaaaaataatgggaataaccgatgacgagtaattcaacaatgtgaccggaatacccaggaaatccaggcccagcgcatccactttttgcccgttctcgaaggcagtcagaattaatggatgcactaacgctccgccaatcaccatggcagtaaatggattgccgctgaagcgtttccctgcggtgtagcccaggattatcgggaagaaccaaaacaaggcatcactggcgctaaataaaattaaataagtaccactttgttcggtcgtccactgaaaagtgagtgccagagccaacatacctttcaggatcccggttgccgccatcaaaccgatcagaggcgtaaaaatacctgaaataacataaacaaagcggtttaacagattacctttatcatcattttccggtgcctgttgcgctttttcgccaaggcctgccacgctgttaaccgccaggaagacatcggccacatggttacctatgacaacctgaaactggccaccgctttccaccaccataataataccgggggtctttttcagtacctcagcttgcgctttgctttcatcctttaacttaaaacgtaatcgcgttgcacaatgcatcagactcacaatgttatctgcgcccccgactcctgcgactattgttctggctaactccgtcataacttgccctctaccgctttgcggcaaaactccaaaaaaaaacctgaaaaaaacggcctgacgtgaatcaagcaatttttttcaggttttgcccgcttagtgcggtaacaatcctttattcagtaataatatttcagtgttctttgcgcacgcgctctatatttatggctaaaaacataatctctgcaggtgagattttacgttgatactgcaaaccaataaaaatggcgatccgctccgcacattgccatgcttgcgggtaattttgctttactgcttgttgtaatgattcatcactatcgttaatcgatgcatgttcaagaatacgccaggataaaaatttcagatgcgtaaccagtcgctgataactcaagctttcttcctggtaattaaggctgaactgaaattttattaattgcagcatttctcgcattaattgcgtgacacctgcaacatcctccatatttccgctcatttgggcactgaccagatgcatggcaataaagcccacttcatctttcggtaactgcacgcccaaccgtttatcaataatggttaacgcttcttcccctagctggaactctttcgggtaaagtcgctggatatcccacagcagcgggttgggcagtagcacgttttgctgaaagcgtttaatcgcaaactggcaatggtcagttagcgagatataaatactgtcctgcaactttcccagacgctcctgcgccagagagataatacgatcacaggttgccatcacctcaagaggcatatgacttaagagttcgcttaatcgcccgttcagttcatgactgctcaaggcatactctttttctattccacttgagttaattctttcgcttgggcgtttttgaaagccaattccgcgccccatgacgactttttcccgctgttgatcatcaataaccaccacaacattattgttgagaattttggtgatttgcatgttcatagcaaggaccttttttataaacaaaaaaacccgacttcaccagtattctctggttatgtcaggttttgcctgcgaatgcagtaacaatccagtcattaattaatggtttttataacgaacatccaggttcgaaaattaatttagttgcgtgcagagaaaatagcaatgctctatttataaaagtatgaccatgctcgcagttattaattttgtgtaattttaggattttataaagttatatataacaaatcccaataattgaattattgggatttacttggtgaattatttatcgctatctttttctgccagcagtttatcgagctcgtcaccaccgacatgacggaaatcctgccccttcacgtagtagaagataaactcacaaatattctggcagcggtcgccaatacgttcgatagaacgcgcacagaataacgcggtaagtacgctcggaatggtacgcgaatcttccatcatgtaggtcatcagttgacgaacaataccttcgtactcctgatcgacttttttatcttcacgataaatacgtaccgcttcgtcaatgtccatccgcgcgaacgcgtccagcacgtcgtgcagcatctggatggtatgacggcccagcgactccagacttaccagcaatggctgatgctgctgggagaatttctccagtgcagtacggcagattttgtccgccacgtcgccaatacgctccagctcggcaatggttttactgatcaccataaccagacgcaggtcgctcgccgtcggctgacgtttggcgataatgcgcacgcaggcttcatcgatcgccacttccatcatgttgacgttcttgtcgccttcgatgacgcgcttcgccagatcgctgtcctggttatgcatcgcggtgattgcatcagaaagctgctgctccaccatgccgcccatggtcatcacctgcgtgcggatgctttccagttcggcgttgaactggccggaaatatgtttattaagattgagactgtccataacgcactcctgaatcaaccgtaacgaccggtgatgtagtcttctgtttgtttcttcgctggcttggtgaacagatcgtccgtgttgctgaactcaatcaattcgcccaggtacataaacgccgtgtggtcggaacaacgcgcagcctgctgcatgttgtgggtgacgatcaccacggtgtaatcctgcttcagttcggtgatcagctcttcaatacgcccggtagagatggggtcgagtgccgaacacggttcgtcgagcagcagcacttccgggcgaatggcgataccacgcgcaatacacaaacgctgttgctgaccaccagagagagagtaaccgctctggtgcaatttatctttggtttcgttccacaatgcggctttggtcaatgcccactgcacgcgctcgtccatgtcagcacgggagagcttctcaaacagacgcacgccaaaagcgatgttgtcgtagatggacattgggaacggcgtcggtttctggaacaccatgcccactttcgcacgcagcagggcgatatcctgagagttggtcaggatgttgtcgccatcgagcagaatttcaccttccgcacgctgttccgggtacagttcaaacattttgttgaaggtacgcagcagcgttgatttaccgcagccggacggcccgataaacgccgtaacctggtttttggcgatatccaggttgatgtttttcagggcatggaatttgccgtagtagaagttcaaattacgaacctgaattttactcggggcagtttcaaccatactcattgcaatcttttcctcatcgtgcctgatgcacttcgcgaatcaggcttaccgtaggccggataaggcgtttacgccgcatccagcaaagtgttaaccgtgtttattcttcgcaaaaacaacgcgcgccagaatgttcagcagcagtacgcacagggtaatgatcaacaccccggcccaggccagttgctgccattccgcaaacgggctcatcgcaaacttaaagatcgtcaccggcaggttggcgatcggctgcatcatgtccgtgctccagaactggttggagagcgcagtaaacagcagcggcgcggtttcaccagcaatacgggcaatcgccagcaggataccggtcatgatcccggacaccgacgccttcagcgtgatcgcggcgatcatcttccacttcggcgtacccagcgcataagccgcttcacgcaggctgtccggcaccagtttcagcatgttctcggtggtgcggataacaatcggcacctgcaacagcgccagcgcaatcacgcccgcccagccggagaagtgctccatctgcgccaccacgatggtgtaaacaaaaagaccaaccacaatcgacggtgcggagagcaaaatgtcgttaatgaagcgaatcacttctgccagccaggatttacgaccatattcagccagataaatccccgccataatgcccagcggcgtaccgaataccgtggcccacaaaattaacaggccgctacccgccagggcgttcgccagaccaccgccttccgtatttggcggcggcgtcatttcggtgaacagcgccagcgacataccatcgataccgcgagtgatggtggacattaaaatccagatcagccagaacagaccgaaggccatcgtcgccatcgagagcgtcagcgcaatacggttcttaaggcggcgacgcgcctgcattttacggcgggattcagccagcgccgcagtggtttgcatttcaaccatagccattagcgtgccccctcattcttagccaggcgcataatcataaacttcgatgcggcgaggacgatgaaggtaatcacaaacaggatcaggcccagttccatcagtgcagcaacatgcagacccgactctgcttccgcaaattcgttggccagcgcagaggtgatactgttgcccggcatatacagcgaggcgctgtcgagttggtaggtgttaccgatgataaaggtcaccgccatggtttcaccgagcgcgcgccccagccccaacatgatgccgccgataacaccatttttggtgaacggaagaacgatacgccagataacttcccaggtggtgcagccaataccgtaggccgactctttcatcatcaccggggtttgttcgaatacatcgcgcattaccgccgcaatgtacggaataatcatgatggcgaggatcacgcctgccgcgaggataccgataccaaaggccgggccggagaacagcgcgccgacaatcgggatattcgacatgatattgccgaccggctcctggaagtaaacggcgaacagcggggcgaagataaacaagccccacatgccgtaaacgatacttggaatggcagccagcagctcaatggcgatacccagcgggcgtttcagccagccaggcgcaagctcggtcaggaacagggcgataccaaaactcaccgggacggcgatcagcagcgcgataaacgaggtcaccagcgtaccgtagatcggcaccagcgccccgtagatatcgttcggcgcatcccactctttggtccacaggaaagccagaccaaatttctgaatgctcggccaggatgagatgatcagagagacaataatgccacccaacatcaatagcacaatcagcgccgccagttttaccagcacgctgaaaattatgtcgccctttttacccggtgggttaaaagcaggcttggttgcagccataagttactcttcagttaaacgcgtttacaaagtcattttgtaatgccggatgcggcgtaaaacaccgtacccggcctggagttttattagtacagcggcttgccgctactgtctttaatattggtcttccacgcagcgcgaacctgttcaactacgctatccggcaggctggcataatccaggtcgttcgcctgtttagccccggttttgtatgcccagtcgaagaacttcagcacttcggtgccttgttctggtttcttctgatctttatggatcagaatgaacgtggtagaggtaataggccatgcatcttcgcctttctggttggtcagatcctgagcgaatgttttgctccagtctgcgccttttgctgcattagcgaagttttcttcggtcggactcaccggtttgccatcagcggagatcagtttggtgtacgccaggttgttctgcttcgcgtaagcatattcaacgtaaccaattgcacccggcagacgctgaacgaacgcggcgataccgtcgttacctttaccgcccagaccgatcggccattttacggtagagccagtaccaacgttgtttttccactcttcgttcactttcgccaagtagctggtgaagacgaaggaagtcccggagccatctgcgcggcgtactacagcaatgttctgtgaaggcagtttcagacccggattcagtttggcgatggcttcatcatcccacttcttgattttgcccaggtagatgtcgccgagggttttaccatccagcaccagttcgccagacttcagacctggaatattaaccgccagcaccacgccgccaatcacggtcgggaactggaacaggccttcctgagccagtttttcatcagacagcggcgcgtcagaggcaccgaaatcaacggtgttagcgataatctgttttacgccaccggaagaaccgataccctggtagttaactttattaccggtttctttctggtaagtgtcagcccatttggcatacaccggcgcagggaaggttgcacctgcacctgtcaggcttgcttctgcaaacacagagaaagcgctcatcgataaggtcgcggcgacaacagttgcgacggtggtacgcataactttcataatgtctcctgggaggattcataaagcattgtttgttggctacgagaagcaaaataggacaaacaggtgacagttatatgtaaggtttatgacagttttatgacagagagagaatgtcttcagtccgatttaaataagagtttatattcagttaattacaaatattaataacgaagagatgacagaaaaattttcattctgtgacagagaaaaagtagccgaagatgacggtttgtcacatggagttggcaggatgtttgattaaaaacataacaggaagaaaaatgccccgcttacgcagggcatccatttattactcaaccgttaccgattttgccaggttacgcggctggtcaacgtcggtgcctttaatcagcgcaacgtggtaagccagtagttgcagcggaacggtgtagaagatcggtgcaatcacctcttccacatgcagcatctcaataatgtgcatattgtcactgctcacaaaacccgcatcctgatcggcgaagacatacaactgaccgccacgcgcgcgaacttcttcaatgttggatttcagtttttccagcaattcgttgttcggtgcaacgacgataaccggcatatcggcatcaatcagcgccagcggaccgtgtttcagttcgcctgcagcgtaggcttcagcgtgaatgtaagagatctctttcagcttcaatgcaccttccagcgcgattgggtactgatcgccacggcccaggaacagcgcgtgatgtttgtcagagaaatcttctgccagcgcttcaatgcgtttgtcctgagacagcatctgctcaatacggctcggcagcgcctgcagaccatgcacgatgtcatgttcaatggaggcatccagacctttcaggcgagacagtttcgccaccagcatcaacagcacagttaactgggtggtgaatgctttggtggaggccacgccaatttccgtaccggcgttggtcatcagcgccagatcggattcgcgcaccagagaagaacccggaacgttacagattgccagcgaaccaaggtaacccagctctttcgacagacgcaggcccgccagggtatccgcggtttcgccagactgtgacaaggtgatcatcaggctgttacgacgcacggcagatttgcgatagcggaattcagaggcgatttcgacgtcgcacggaatacctgccagcgattcaaaccagtagcgggaaaccataccggagttataagaagtaccacaggcgaggatctgaatatgctcaaccttcgacagcagttcatcggcgttcggtcccagctcgcttaaatcaacctgaccgtggctgatgcgcccggtaagggtgtttttgatcgcgttcggctgttcgtagatctctttctgcatgtagtggcggtaaatacctttatcgcccgcgtcatattgcagattggattcgatatcctgacgttttacttccgcgccagttttatcgaagatgtttaccgaacggcgagtgatttccgcaatatcgccctcttcaaggaagataaagcgacgagtcactggcaacagcgccagctggtcagaagcgataaagttttcgcccatacccaggccaatcaccagcggactaccagaacgtgccgccagcagggtatccggatgacgggagtccatgatcactgtaccgtacgcaccacgcagttgcgggatagcacgcagaactgcctcacgcagagtaccgccttgtttcagctcccagttcaccaaatgtgcaatcacttcggtgtcggtttcagaaacgaaggtatagccacgcgcttttaactcttcacgcagcggttcatggttttcgatgatgccgttatgcaccaccacaatgtgttcagaaacatgcggatgcgcgttagcttctgaaggttcaccgtgggtcgcccagcgagtatgagcaataccggtgccgccatgcagaggatgttcttccgctgcctgagccagcatctggactttaccgaggcgacgcaggcgggtcatatgaccttctgcatcaacaacggccagaccggcagagtcatatccgcggtattccagacgacgtaaaccttcaagaaggatttctgctacatcacgttgcgcgatcgcgccaacaattccacacatagtttttgattccgatttatatcgttgtcggtcaacctgtatgcccgtttttcgggcgccccgagccttgtagagagtgggggtatttttatagttactgcttgtgggcgggagattatgttatctcctcatcccatatgaccggattacccggccagaattactttttctttaccggacgacgccagccttctttttgagtctgcggcacacggctgatagccagggcattttcgccgacattacgcgtcacagttgtaccagcagcaatggtcgcgcctttgcctactgttaccggggccaccagctgagtatcggatccaacaaacacatcgtcgccgataatggtcttaaatttattcgcaccatcgtagttgcaggtaatggttcccgcgccgatgttaacgttatcgccaatttccgcatcgcccaggtaagtcagatgaccagctttcgagcctttacccagacgcgcttttttcatctcaacgaagttgccgacgtgtgcgccttccagcaactcagcaccaggacgcagacgggcaaacgggccaatggtacaggccgctgccagattcgcatcttccacaacggtatacgggctaatttcgcaatcatcgccaatcacgctgtttttaatcacacaaccggtgccgattttcacacgattaccgagagtcacgttgccctcgatgataacgttagtatcaatttcaacatcgcgcccgtgagtaagcgtaccgcgcagatcaaaacgcgccggatcgcgcagcataacgcctgctaacagtagtttttcagcctgttcggactggtaaacgcgctccagtcgggagagttgcaggcggttattcacgccttctacttcgcttaaacgttgcggatgaacggcgacgatttcacgtccttcctgatacgccagcgcaataatgtcggtgatgtagtattcgccctgagcattattgttggtcagcttcgccagccagcgtttcatatctgcgccgttggcaatcagaatgccggtgttgatctcctgaatctgacgctgctcgtcggtggcatctttgtgctcaacaatgccggtaactttgccgttttcacgggtgatacgtccataaccggtcggatcatccagttttaccgtcagcagaccaatgccaccctgcggtttagcatcacgcagacgctggagtgtttcgacagagatcagcggcacgtcgccgtagagcattaaaatgtcttcatcatcggcaaagaaaggtgcggcctgctgcatcgcatgacccgtacccagctgttctgcctgaagcacccagttcaggttgtcgtctttcagcgcctgcttaagcagatcgccgccgtgaccatacacaaggtgaacgtgcgctgcgcctaattcattcgcagcatcaatgacatgctgaaccatcgctttcccggcaagggtatgcagcactttcggaagatcggaatacatgcgcgtgcctttgcctgcggcaaggatcactacgctcatagcattattcaacatacgcgtcctgactgtaatttgagaacgaatttaaaccgcttcaccttgaaaaaactacatttttttcatcgtgaaatggacagaggataaattgttcaataacggattatccccgctgacgaaagcgccattttcgaccatcgtcacgccttttgtctgcagaaaattaaggcagtaccttcatttaagcgtcaggtggatgtttttgctcttatttcgatcaatgaataaacgggaaaacaggggtgttttatatcatcaggatctatgtgaacgcttttcaggacgggtcaatacgcgtaaaaaaaagccagcctgttgccagactggcttttgtgcttttcaagccggtgttacatcgcttttttggtcaactcgataacgcgcagctgcgcgatcgctttggccagttccgcagacgcctgagcgtaatctacgtcgccgtgagagctgctaatgtgctcttcagccttacgtttcgcttccatggctcgcgcttcgtcgagatcctggccgcgaattgcggtgtcggccagaacggtcacgttgccaggctgcacttcaagaatgccgccagacagatagataaactcttcgtgaccgtgctgtttcacgatgcgaatcataccaggcttaatggcggtgagcagcggtgcgtggccagggtagatccccagttcaccttcgctacccgttacctggattttctcgaccagaccagagaacatttgttgctctgcgctgacgacgtccaggtggtaagtcattgccatatcaccctccgattaaggcgttaaagttttttggctttttccacagcttcttcgatggaaccgaccatgtagaacgcctgctccggcaggtgatcgtattcgccttccatgatgcctttaaagccacggatggtgtctttcagggagacgtatttacccggagaaccggtgaatacttctgccacgaagaacggctgggacaggaagcgctggatcttacgagcacgcgctaccaccagtttgtcttcttcagacagttcatccatacccaggatggcgataatgtctttcagttcctgataacgttgcaggatggactgaacgccacgcgcagtgtcgtagtgttcctgaccaaccaccagcgggtccagctgacggctggtggagtccagcgggtcaacggccgggtagatacccagagacgcgatctgacggctcagtaccacggttgcgtcaaggtgcgcaaaggtggttgccggagacgggtcagtcaagtcatccgcaggtacgtatactgcctgtacggaggtgatagaaccggttttggtggaggtgatacgttcctgcagaacgcccatctcttccgccagggtcggctgataacctaccgctgaaggcatacggcccagcagtgcggatacttcggtaccggccagggtgtaacgatagatgttatcgacgaacagcaatacgtcacgaccttcgtcacggaatttctcagccatggtcagaccggtcagagcaacgcgcagacggtttcccggcggctcgttcatctggccatacaccagggatactttgtcgataacgttggagtcggtcatttcgtggtagaagtcgttaccctcacgagtacgttcacctacgcccgcaaacacagagtaaccggagtgctcgatcgcgatgttacgaataagctccatcatgtttacggttttacctacacccgcaccaccgaacagaccaactttaccgcccttagcgaacggacacatcaggtcgataactttgataccggtttccagcagttcctgagagtttgacagctcttcgtaggaaggtgctgcgcggtgaatcgcccaacgctcttcttcaccgatctcgcctttcatgtcgaccggttcacccagtacgttcatgatacggcccagagtcgctttacctaccggtacttcgatcgggtgttcgaggtcttttacatccagaccgcgacgcagaccgtcggaggaacccattgcgatggtacgcacgataccgccgccgagctgctgctgaacttccagcaccagacgctcattaccattttgcacctcaagagcatcgtacacgcgcggtacggcatcctgagggaattcgacgtcaactacggcgccgattacctggacaatctttccagtagccatcttaaatcctctacgaaataacctgtttaaaccgcggcggcccccgagacgatctcggtgagttcctgagtaatgctggcctgacgagctttgttgtataccaactgcagctctttaatcaggctgccgccattgtcggtcgcggctttcatcgccaccatacgggcggcctgctcgctggccaggttttcaaccacgccctgataaacctgagattcgacataacgacgcagcagggtatccagcaacgccttcggatcgggttcgtacaggtaatcccaggatttgtgtttcagatcatcatcatctgatgccggtaacggcagcagctggctgatggtcggaacctgagacatggtgttaataaatttgttgctgacaatgtaaagcttgtccagacggccttcgtcgtaggcctgcaacatcacttttaccggaccgatcagttcggacagggaagggttatcccccatgccggtgacctgggcaacaacattgccgcccacggagttgaagaacgacacgcctttcgagccgatcattgcgaggtcgcattgaacgcctttgtcggtccaggtcttcatttccgccagcagttttttgaacaggttaatgttcaaaccaccgcacaaaccacggtcggtcgacaccaccaggtagcccacgcgtttaacgtcgcggtcttccaggtaagggtgcttatattccagattaccgtgtgcaaggtgaccaatcactttgcgcatggtttctgcataaggacggctggccgccatgcgatcctgcgatttacgcattttggaagcggcgaccatctccatcgctttagtgatcttttgcgtgttctggacgcttgcgatcttactacgtatctcttttgcgccggccatgagcttctcctcaatgccttgcggcctgccctaaggcaagccgccagacgttaccaggattgggttgctttgaaggaatcgaggatgcctttcagcttgccttcgatttcgtcgttgtagccaccggtctggttgatctcttgcatcaacggagcgtgatcacggtcgacgtaagccagcagagcggcttcgaagctgccgattttcgacagttcaacatccgccaggtaaccacgttctgctgcgaacagaaccagagactgttgcgctacggacatcggcgcatactgtttctgtttcagcagttcggtcactttttgaccgtggtcaagctgcttacgtgttgcatcgtcaaggtcggatgcaaactgagagaacgctgccagttcacgatactgtgccagagcggtacggataccaccggacagttttttcatgatcttggtctgtgctgcaccaccaacacgggatacggaaatacccgggttaaccgcaggacgaataccggcgttgaacaggttggtttccaggaagatctgaccatcggtaatggagattacgttggtcggaacgaacgcagaaacgtcacccgcctgagtttcgataatcggcagcgcagtcagagaaccggttttccctttcacttcacctttggtgaaagcttcaacgtattcggcgttaacacgcgcagcacgctccagcagacgagagtggaggtagaatacgtcgcccgggaatgcttcacgtcctggcggacgacggagcagcagggagatctgacggtaagcaacagcctgtttagacaggtcatcgtaaatgatcagcgcatcttcaccgcggtcacggaagtattcacccattgcgcaaccagcgtacggtgccaggtattgcagtgctgcggattcagacgcggttgctaccacaacgatggtgttagccagtgcgccgtgctcttccagtttacgtaccacgttagaaatggtggacgctttctggccgatagcgacatagatacatttgataccggaatcgcgctggttgatgatggcatcgatagccagtgcggttttaccggtctgacggtcaccgatgatcaattcacgctgaccacgaccgattgggatcatggagtcaacggctttataaccggtctgtaccggctgatctacggactgacgttcgataacgcccggagcgattgcttctacagcagagaagccgtcgtgatccagcggacctttaccgtcgattggtgcacccagagtgttaaccacacggcccagcaggccacggccaaccggaacttccaggatacggccagtacacttaactttcatgccttcggcaaggtcagcgtacggacccataacaaccgcacctacagagtcgcgctcgaggttcagtgcgatagcgtaacggttacccggcagggagatcatttcaccctgcatacaatcggccaggccgtgaatgcggataacaccgtcacttacagaaacaatagtaccttcgttgtgagcttcactcacaacattgaactgagcaatgcgctgcttgatcagttcgctgatttcggtggaattcagttgcatgctccagtccccttaagactgcaagacgtctgcaaggcgctcaagacgaccgcgtacgctgccatcaatgaccatatcacccgctcggatgataacgcctgccattacagacttatcgattttgcaattcagcttaactttgcgtgacagacgtttttccatcgcagcagaaattttcgcgagctgttgttcactcagtgcggcagcggaaatgacgtctacctcagcggtagcctcactcacggcacgcaggtgaataaactgctccagaacatccgggagcgccttaagacgaccattttcagccattacccgaatcaggttctgaccgttttcgtccagttgctcaccacaaactgcgataaacgactcggcgagcgtttctggcgcaagcgcgccagagagaagctctgccatttgttcgtttttggttacctcggcggcaaacgccagcatgtcctgccagcgttctacactttggtgttcgacggcaaagtcaaaagctgctttggcgtaggggcgagctaccgtaataaattcagacatcagcccctccctccttacagttcagcgacaagtttatccacgatgtcgctgttagcagcttcatccacggaacgttcgatgatcttctcggcgccagcaacagccaggatagcaacttgcttacgcagctcttcacgggcacgtttacgctcggcttcaatttccgcctgcgcctgggccacgattttagtacgttcctgttctgcctcagctttcgcttcatccagaatctgcgagcggcgtttgttagcctgctcgatgattacctgggcttccgctttcgcttttttcagctggtcggtcgcgctggcctttgcaaggtcaaggtccttatgtgctcgttctgcggaagcaaggccgtcagcaatttctttttgacgtttttcgatggctgccattaatggcggccatacgtacttcatgcagaacagaacgaacaggacaaacgcgatggcctggccgaggattgttgcgttaagattcacagcacaatgcctctatttagttaacgttctgatattgctctttaaataaaagcaacgcttactacgcgacagcgaacatcacgtacagacccagacctacagcgatcatcgggatagcatccaccagacccataacgataaagaactgagtacgcagcagaggaatcagatcaggttgacgcgctgcgccttccaggaatttacctccgaggatgccgataccgatcgcagcaccgattgccgccagacccatcatcacagcggcagccatgtacagcagatccatattcaggttttccatgacagtctccagtttgtttcagttaaaacgtagtagtgttggtaaattaatgttcttcagacgccatcgacagatagacgatcgtcagaaccatgaagatgaaggcttgcagcgtaatgatcaggatgtggaaaatggcccacggcacattcaggatccactgtgaccaccacggcaacagaccagcaatcagaatgaaaatcagctcaccggcatacatgttaccgaacagtcgcaaaccgagtgaaactggtttggacagcaggcttaccccttcaaggattaagttgacaggaatgaacgcccagtgattgaacggctgcagcgtcaactctttcgtgaagccgccgatgcctttcattttgatgctgtagaacagaatcaggataaatacgcccagtgccatagacagcgttacgttcacgtcagcagacggaaccacacgcagtgcaggcagacccagtacatgttcagcaatgtacggcagcaggtcgataggcagtaaatccatcaggttcatcaggaatacccagacgaagatcgtcagggccagcggagcaatcagcttgcttttgccatggtacatgtctttcacgctaccattaacaaagccgatcaccagctcaatcgcggtctgaaacttacctggcacgccgctggttgcctttttggctacactacggaataaaaccaggaacaacagacccagcaccaccgagaagaacatggagtcaatattgattgtccagaaggtggctggggggttatgtggatccaccagcgagaatgtacgcaggtccagctgaaggttattcaggtggtgtcctatgtaatcctgcggcgtcatattttctgaagccatgatgccttttaccctttgttgttaattacagccggtgccagtatctgaaccaccagcaccaaaacccacgtaacgatcagcggcaagaataccgcctttaaaaccgccaacgccaccaccagtaacaccaacatcgccagaactttgaaagcttcgccaaatgcgaatgtccaggccacccggcctttcgctggtgtatgcgcctggtgacgccaggcaaatatcataaacaaaacgttaggcagaaagactgccaggcccccgcttattgcagagacgccccagaaggggtctttgaggctgaacagcaatccacttgctatcaccaccagtaactgaacgagcagaagcttccgagcaacgtttcgactcacgagcgacacagacatcacgtttttcactcctgctcccttcgaggtatgccgcgtgtcgtataaaactttctttaaggcttagagtcaagcatcaaaaagcggtcaaattatacggtgcgcccccgtgatttcaaacaataagtagccaaaaggtgaataaatgtttaaatatttttccagtgcatacaattgcgacttttctgcaaaccctgttcgatcatgaaaaactgtaaataacgcgtaaacactggtgataaagcgtgcttcagatcacatattgcgcatgttcgcgcacagcatatttatttacttggcaaatgatgcctttgcaagtttatgatatttcagtctaaaaacagatactattttaataaatgacatttacataacaaaaaccacccattgacatttttaataatgttttaacagtcaatgatgattcttagcgccgatttttagcagactgatattttcacttatgacttattttctgcttaccaaaaaaagccacgttatcttgttgatacaaaagagtgaacgtggcgttaaatgtaaccagttatatcagtagaaaacctggttgttgttaacagtctaaccggtcaattttttatgatttttttgataaaaattaaattttatttgctttaatcaccaccagatgacgttcgccatccagggctggaacctgaagtttaaccactgattcgacctgatattcttcgggcaacaaagcgatttcatcttccggcatttgccctttcagcgcgtagaaacggccttgctcaccaggaagatggtggcaccagctcaccatatcgttcagagaggcaaaagcgcggctaattacgccatcaaatggcggctctgacggaaactcttctaccctgctctgtactggctcaatattctccagtttaagctcatgttgcacctgacgaaggaaacgcacgcgtttaccaaggctatccaacaacgtgaaatgagcttcaggacgtacgatagagagtggaatgccaggcagtcccggtccggtgccgacatcgataaaccgttcaccttgcagatacggtgccaccacaatgctatcgagaatatggcgtaccagcatctcattaggatcgcggaccgaagtaaggttgtacgctttattccatttatgcagcatattcacgtaggcaataagctggtttttctggtgatcggtaagcgaaatacctgcgtctttcagcagtaaggagagtttgttgagcacggtgattacctgttcttgatgcgttgcctggtaagcgggtgcttaccaggcatttttaatgcgttatgcgctacgacgcagcataccctgttttttcagccacaccagcagaatggagatagccgcaggcgtgacgccagaaatacgcgaagcctggccaatagaggccggtttgtgatcgttaagtttggcgatcacttcgttagaaagaccggatacctggcggtaatccagcgtcgctggtagcagggtattctcgttacgcagctgcttttcgatctcatcttgctggcgcgcgatataaccttcgtatttaacctgaatctcaacctgttccgcagcctgttcatctgtcaacgcaggggcaaacggtgtcagcgtggttaatttttcataagtcatttcaggacgacgtagcagatcttcaccactggcttcacgggaaagcggcgcagtcaggtgagcattcacttcggctgcagcttccgccgacggggttacccaggtcgatttcagacgctgacgctcacgctcgatattctcaagtttctcgttaaagcgcgcccaacgttcgtcatccaccaggcccagttcgcgaccgatttcagtcaaacgcagatcagcattatcttcgcgcagcatcagacgatattctgcgcgcgaggtaaacatacgatacggttctttggttcctaaagtgcacaggtcatcaaccagtacgccgagatatgcctgagaacgcgccggagcccaaccttctttgtcagcagacagacgggcagcgttaagaccagccagcaaaccttgcgcagcggcttcttcgtaaccggtagtgccgttaatctgaccagcaaagaacagcccctggataaacttgctctccagcgtcggtttcaggtcgcgtggatcgaagaagtcatactcaatggcataacccggacgcacgatcttcgcgttttccatcccctgcatggagcggacgatttgcatctgcacatcgaacggcaggctggtggagataccgttcggataaatttcgttagaggtcagcccttccggttcaaggaagatctgatgctgatttctgtcggcgaagcgcatgactttgtcttcgatcgacgggcagtagcgtgggccgacaccttcgatcacccctgcgtacattgggctacgatcgaggttactgcggatcacatcatgggttttctcgttggtatgagtgatataacacggcacctgctggggatgctgggacgcattgcccataaacgagaatactggcattgggttatcgccatgctgttgcgccagtacgctaaagtcgatggttcgagcatcaatacgcggtggtgtcccggttttcagacgaccaacgcgcagcggcagttcacgcaaacggcgagaaagcggaatggacggcggatcaccagcacggccaccgctgtaattatccagaccgatatgaattttaccgtcgaggaacgtcccaacggtgagcacgacagctttggcacggaacttcagtcccatttgggtaacggcaccgaccacgcgatcgttttcgacaataagatcttcaactgcctgctggaagatcatcaggttcggttggttctccagcgccgtacgtaccgcctgacggtagagcacacgatctgcctgagctcgggtagcgcgaaccgccggtcccttgcttgcgtttagtatcctaaactggatacccgcctgatcgatcgctttcgccatcagaccgccgagtgcatccacttcttttaccagatgtcccttcccaataccgccgatcgccgggttgcagctcatctgccccagagtgtcgatattgtgtgtcaaaagcagagtctgttgacccatacgcgccgcggccatcgcggcctcggtgcctgcatgacccccgccaatgatgatgacgtcaaaaggatccggataaaacatggtgattgcctcgcataaagcggtatgaaaatggattgaagcccgggccgtggattctactcaactttgtcggcttgagaaagacctgggatcctgggtattaaaaagaagatctatttatttagagatctgttctattgtgatctcttattaagatcgcactgccctgtggataacaagtatccggcttttaagatcaacaacctggaaaggatcattaactgtgaatgatcggtgatcctggaccgtataagctgggattagaatgaggggttatacacaactcaaaaactgaacaaccgttgttctttggataactaccggttgatccaagcttcctgacagagttatccacagtagatcgcacgatctgtatacttatttgagtaaattaatccacgatcccagccattcttctgccggatcctccggaatgtcgtgatcaagaatgttgatcttcagtgtttcgcctgtctgttttgctccggaatttttgagttctgcctcgattttatcgatagccccacaaaaggtgtcatattcacgactaccaataccgattgcgccaaagcggaccgcagaaagatcgggcttctgttcctgcaatgcttcatagaaaggagaaaggttgtccggaatatctccggcaccgtgggttgagctgataaccagccagatccccgaggcagataaatcttccaacagcggaccgtgcagcgtttcggtggttaaacccgtctcttccagcttttcagccaggtgttctgctacatattcggcaccgccgagggtgctgccgctgataagagtgatatctgccataaaccgccacctttattaagagtggcgtattgtacgctgtgaacgcgttgggatctacctgtggaaaagtatgggattaaaaaagccgatcagggcttaatggtacgcatgatcgggttctgcaggacgatcagtgtctcggtggactgaatttcatcaattgtttggatcttgttgataagtacatgctggagagcatcgatcgaacggcacatcacttttataaagatgctgtagtggccggttgtgtaataggcttcagtgacttcatcgaggctttccagctttgccagcgcggaaggatagtctttggcgctctttaatataatgccgataaagcagcctacgtcataaccaagctgcttcgggctgacatcaatacgcgccccggtaatgatccccgcctgcttcattttctctactcgaacgtgaatcgtccccggactgacgccaaattgtttcgccagttcggcgtaagcggtgcgcgcattgcccattaatgcttccaggatgccacggtccagattgtcgatcagataattttccataggattttcttatgcggattgatgattcattctattttagccttcttttttaatgaatcaaaagtacgtgaggctttttattgaatgattattgcatgtgtgttggtttttgttgcttaatcataagcaacaggacgcaggagtataaaaaatgaaaaccgcttacattgccaaacaacgtcaaattagcttcgtgaaatctcacttttctcgtcaactggaagaacgtctggggctgatcgaagtccaggcgccgattcttagccgtgtgggggatggcacgcaggataacttgtcgggctgtgaaaaagcggtgcaggtaaaagtgaaagctctgcctgatgcccagttcgaagtggttcattcactggcgaagtggaaacgtcagaccttagggcaacacgacttcagcgcgggcgaagggctgtacacgcacatgaaagcccttcgccccgatgaagaccgtctttccccgttgcactcggtctatgtagaccagtgggactgggagcgcgtaatgggcgacggcgagcgtcaattctcgactctgaaaagcacggtagaggcgatctgggcgggaattaaagcaaccgaagctgcggttagcgaagagtttggcctggcaccgttcctgccggatcagatccatttcgtacacagccaggagttactgtctcgttatccggatctcgatgccaaagggcgtgagcgggcgattgcgaaagatcttggcgcggtattcctcgtcgggattggcggcaagttgagtgatggtcatcgccacgacgtgcgcgcaccggattatgatgactggagcaccccgtcagagctgggccatgcgggtctgaacggcgatattctggtgtggaacccggtactggaagatgcgtttgagctttcttccatggggatccgcgtggatgccgacacgctgaagcatcagctggcgctgaccggtgacgaagatcgcctggagctggagtggcatcaggcgctgctgcgcggtgaaatgccgcagaccatcggcggcggtatcgggcagtctcgtttgaccatgctgctgctgcaactgccacatatcggccaggttcagtgtggtgtatggccggcagctgttcgcgagagcgtcccttctctgctgtaataatttatcgccgccagcgtctgagcaggcggcttcgcatcccggtatcaaagcgccagatatgatcgaaaatgcgcatgatgccgggtttgccgtgtgccgacatcgccacggcatgaaagcgatgctgatgtacccgctgcaactctttcactttactcgtcacgtcgtcaggcaaccgctgggcgataaaatcagaaatcaccaccgcatcggcatcaaaccattccctgctttgcaagcgttccataatggcgcgaaaacaactggcaagatcggtgccgccacgaaactgctgacttaaaaagcggatcgcttgctcaataccttgtggccctgaaagctcataacggacgatctcggtggaaaatagcataatatagcagcgccggttttcagcgagggctatgcgcatcaaggccaggcagaacgctttcgcacactgttcattaaagccgcccattgagccggaagtatctacgcagacaataaacggtccgcgcggctgttcgtcgtaatctttatgcaccaccgggcgttcgatcattttttcacgccacgactcaccgtgcaggcgataggtaagcaactgtttttccaccagccgacggtaaaactcatactccagttccgttatccctagtgtcgccagttctggcggcaagagacgtaaaatatcatcgctttgctgcagaccatcaacctgctcaggaactgtcgccggttcgcgcaccatggtgcggaaggtttccatctgcgcatcgttgcgcggtattgatttggcttcccgggaacgccccagctgttctgccagacgtttcagttccggctgttcgttaagaaattcaccgtatttcacaatcaactgatagtcgctacgtttaagctgaccggcgctcatatcccacagacgaccagctgcggtattgttatctgcgagaatcggttcaagttgcccgctcagcgtcatgcgttcctgaacttcactcaacagttgttcgcgttcttcttctaatagctgctgatttaacgtcgttgcttgcacgatcaggcttaaacgccagcgctggagaaaaagcgtgtgtaacgctgaagtgatcgtactgttagcatcaaccaactgtcgggcttgttctgcccatggggaattcagacgatgcagtaagtccaggatttgtggtagctgcacaataaactgcggcgtggagaggagctggctttgctgatagcacatcacctcttcggtgagttccggcgggactcgggcatctttcagccgactgcgcagcgcctcacgccagcggggaacatcatcagtgattgccgccttcagtcgtgggaatttttcaaagaagactgccagctgcggtgaggccagcagcgcgatgatcatctcttcgatcaatccctcttcgctgacggccagcatcacattaagcgtatccagcgttagcattgttgtgcctggcgaatctgtgcgccgacatcctgtaggctggcttcaatgcgacctaaccagtcgccagggataaacagacatttttgctgttcgctgaataaagcgtgttgcttgcgccagtcgctttcaagctcttccagttgttgttttatttcgctgggcagaccttcagccgatgaaccgggaagtgctagcgtactgccttgtaaactcacatcgcgtacaaccagatgttgggcgctatcgacttccagattcagtttctgggcaaagccgataccgttcagtttgccgcgaatctcaccacctttactcagccactgttccagcgcgctacgctcaaaggagatatgaaccacttccatatcatgcaattttaacggtttttgcagcagcagagtcagagtggaagcagtaacgttaacagggagttgatactgctgacgacggctaaaaatgccgcccagacgaattaccgttaaggctgttttatcgctttgttgctgctgaagttgcaggtgacgttgcacaatcgcgcccaggcgggtcaacatcccttgctgttgccaggcgtgaccggtcatcaatacatcaatttgttgttgtatcaaattcaggctttgcgcgtcataccacaggcaatctttcagcaaaatgagatcaaccggggcgacagcactgcgaccgctaaaaaaggcgctggcctgcaataagcggatcgcttttttccagcgacgatccgagacataaggcgcatccggtaatttatccagttgctggcgcagcataaaaatcagctcaaatacatgatcgggcagcgtaatttcaccaatctctttctgccagcgttcatattcttcatctgtgatctgcaaggaggcaggaaccggattgtcattttcatcctgttgactggtcagcatggagcggaaattcgctttatcctgcactttatctaaccacagacgaatcagcatgcggtcatataacgcttccagactgctgtctgcttccggcagctcgttggaggccgccaccagcagacgcatcgggattttttctacgagtgcgccgttgcggaactggcgctcgttaatggcggtgagcagggtattaagaattgccggacccgctttccagatctcatccagaaagacgatttcagcttccggcaggtaaccgctggttaaacgttcatagcgcccttcatcttttagcgcctgaatagaaaggggaccaaaaacttcttccggcgtggagaagcgggtcatcagatattcaaacgcgcgggcattctgaaaggcgaattttaagcgccgggcgatcaaacttttggcaatacctggtgggccaaggaggaacacactttcaccacttaatgccgctaataaacacaagcggatggcgtggctacgttcataaagccccttttccaacgaactgctcaggcgggaaattctttccgctaataaatgagggtgagccataatgaagtggcgtcctttcgtcaaaagttctgcgtaaattgcgagtatagacgtttcttgctggtggctaaaatagtctcaaaggaggggtatttttctttgagccaggttaatgtggccgcatttaggagtacgattttgccgttaatcgtgcatactgtgcgcttttttgtgggccaagggactaagcacacatttcatatttcaacgaaagactagtctatgagcactgataataagcaatcattgcccgcgattaccctcgcggcgattggagttgtctacggcgatattggtaccagcccgttatatacacttcgtgaatgtttgtccggccagtttggttttggcgttgaacgcgatgccgtgtttggctttttatcgctgatcttctggctgctaatctttgtggtttccattaaatatctcaccttcgtgatgcgggcagataacgccggtgaaggggggatcctgacgttgatgtcgcttgccgggcgtaatacgtcggcgcgaaccacatcaatgctggtgattatggggctaatcggcggcagctttttctatggtgaagtcgtcattactcccgctatttcggtgatgtccgccattgaaggtctggaaatcgtcgccccgcagctggatacctggatagttcccctctcaattatcgttctcacattattattcatgattcaaaaacatggcacggctatggtcggtaagctgtttgcgccgatcatgctgacctggtttttgattctggcagggctggggttacgtagcattattgctaacccggaagtgctgcatgcactgaatccgatgtgggcggtgcatttcttccttgaatacaaaacggtttcttttattgcattaggggcagtggtgctgtcgattacgggggtcgaggcgctgtatgctgatatggggcactttggtaagttccctattcgtctggcgtggttcaccgtcgtattgccttccttaacccttaattacttcggccagggagcgctgttgttaaagaatccggaagcgattaagaacccgttcttcctgttggcaccggactgggcgctgatcccgctgctgatcatcgccgcactggcgacggtaattgcctcgcaggcggttatctctggcgtcttctcattgacgcgtcaggcggtacgtctgggatatttgtcgccgatgcgcattattcacacttccgaaatggagtcagggcaaatctatattccctttgtgaactggatgctctatgtcgcggtcgtgattgtgattgtcagctttgagcactccagcaacctggcggcggcgtacgggattgcggtgaccggaaccatggtgctgacgtctattctctcgactaccgtggcacgtcagaactggcactggaataagtattttgttgcgctgatcctgattgctttcctttgtgtcgatattcccttgttcaccgctaacctcgataaactgctctccggcggctggttgccattgagcctcggtacggtgatgtttatcgtgatgaccacctggaagagcgagcgtttccgcttgctgcggcggatgcatgaacatggtaactctctggaagcgatgattgcttcgctggagaaatcaccgcccgttcgcgtgcctgggaccgcggtgtatatgtcgcgtgcaatcaacgtcattccctttgcgctgatgcataacctgaaacataacaaggtattgcatgagcgggtgattctgttaactctgcgcaccgaagacgcgccatatgtccataacgtccgtcgggtacagattgaacaactgtcgcccactttctggcgcgtggtggcaagttatggttggcgagaaacgccaaacgtggaagaagttttccaccgctgcggtctggaaggattaagttgccggatgatggaaacctccttctttatgtcgcatgagtcgttgatcctcggcaaacgcccgtggtatttgcgtctgcgcggcaagctgtacttgctgctgcaacgtaatgcgctgcgggcaccggatcaatttgaaatcccgccaaacagagttatcgaactgggtactcaggtcgaaatctaacgccagacgcctcctttctccataagggggcgtttttgttttcatggttaatcaccatgtaaaacgtttcgaggttgatcacatttccgtaacgtcacgatggttttcccaactcagtcaggattaaactgcgggtcagcgaaacgtttcgctgatggagaaaaaaatgaaaaaaggcaccgttcttaattctgatatttcatcggtgatctcccgactgggacataccgatacgctggtggtgtgtgatgctggtttacccatccccaaaagtgcaacgcgtatcgatatggcattaacccagggtgtaccttcttttatgcaggtgctgggcgtcgtcacaaatgaaatgcaggtcgaggctgtcattatcgcggaagagatcaaacaacataatccgcaactccacgaaacgttgctcactcaccttgagcagctgcaacaacaccagggaaacaccattgagattcgttacaccacgcatgaacaattcaaacaacaaaccgcagaaagtcaggcggtaattcgcagcggagaatgttctccgtatgcgaatatcattctctgtgctggcgtgacgttctgaggccgtcatggaagcattacttcagcttaaaggcatcgataaagccttcccgggcgtaaaagccctctcgggcgcagcgttaaatgtctatccgggccgcgtgatggcgctggtgggcgaaaacggcgcgggtaaatccaccatgatgaaagtgcttactggtatctatactcgcgatgccggtacgcttttatggttggggaaagaaacgacatttaccgggccgaaatcttcccaggaagccgggattgggattatccaccaggaactgaacctgatcccgcagttaaccattgccgaaaacattttcctcggtcgtgagtttgttaatcgctttggcaaaattgactggaaaaccatgtatgccgaagcggataaattgctggctaaacttaacctgcgctttaaaagcgacaagctggtgggcgatctttccatcggtgaccagcaaatggttgaaatcgccaaagtgctgagttttgagtcgaaagtcatcattatggatgaaccgaccgatgcgctgaccgataccgaaaccgaatccttgttccgcgtcatccgcgagctgaaatcgcaaggccgcggtattgtctatatctcccaccgcatgaaagaaatcttcgagatttgcgatgacgttaccgtttttcgtgacggacaatttattgctgagcgcgaagtggcatcactgaccgaagattctctgattgagatgatggtgggccgcaagctggaagatcaatatccgcacctggacaaagcgccgggagatatccgcctgaaagtcgataatctctgcggacctggcgttaacgatgtctcttttactttacgcaaaggcgaaattcttggcgtctctggtttgatgggcgctgggcgtaccgaactgatgaaagtgctctacggtgcactgccgcgcacaagcggttacgtcaccctggatgggcatgaagtcgttacccgttcgtcgcaggatggcctggcaaacggcattgtttatatctccgaagaccgtaaacgtgacggtttagtgctgggcatgtcagtaaaagagaacatgtcgctgaccgcgctgcgctacttcagccgcgctggcggcagtttgaagcatgccgatgaacagcaggctgtgagtgatttcattcgtctgtttaatgtgaaaacgccatcgatggaacaggcaattggtctgctttccggtggcaatcagcaaaaagtagcgattgcccgtggtctgatgacacgccctaaagtgttgatcctcgatgagcctacccgtggcgtagatgtcggcgcgaaaaaagagatctatcaactgattaaccagttcaaagccgatggcttgagcatcattctggtgtcatcggagatgccagaagtattaggcatgagcgatcgcatcatcgtcatgcatgaagggcatctcagcggggaatttactcgtgagcaggccacccaggaagtgttaatggctgccgctgtgggcaagcttaatcgcgtgaatcaggagtaaaaaaatgacaacccagactgtctctggtcgccgttatttcacgaaagcgtggctgatggagcagaaatcgcttatcgctctgctggtgctgatcgcgattgtctcgacgttaagcccgaactttttcaccatcaataacttattcaatattcttcagcaaacctcggtgaacgccattatggcggtcgggatgacgctggtgatcctgacgtcgggtatcgacttgtcggtaggttctctgttggcgctgaccggcgcagttgctgcatctatcgtcggcattgaagtcaatgcgctggtggctgtcgctgccgctctcgcgttaggtgccgcaattggtgcggtaactggggtgattgtagcgaaaggtcgcgtccaggcgtttatcgctacgctggttatgatgcttttactgcgcggcgtgaccatggtttataccaatggtagcccagtgaataccggctttactgagaacgccgatctgtttggctggtttggtattggtcgtccgctgggcgtaccgacgccagtctggatcatggggattgtcttcctcgcggcctggtacatgctgcatcacacgcgtctggggcgttacatctacgcgctgggcggcaatgaagcggcaacgcgtctttctggtatcaacgtcaataaaatcaaaatcatcgtctattctctttgtggtctgctggcatcgctggccgggatcattgaagtggcgcgtctctcctccgcacaacccacggcggggactggctatgagctggatgctattgctgcggtggttctgggcggtacgagtctggcgggcggaaaaggtcgcattgttgggacgttgatcggcgcattaattcttggcttccttaataatggattgaatttgttaggtgtttcctcctattaccagatgatcgtcaaagcggtggtgattttgctggcggtgctggtagacaacaaaaagcagtaataacgactacaggacatcttgaatatgaacatgaaaaaactggctaccctggtttccgctgttgcgctaagcgccaccgtcagtgcgaatgcgatggcaaaagacaccatcgcgctggtggtctccacgcttaacaacccattctttgtatcgctgaaagatggcgcgcagaaagaggcggataaacttggctataacttggtggtgctggactcccagaacaacccggcgaaagagctggcgaacgtgcaggacttaaccgtccgcggcaccaaaattctgctgattaacccgaccgactccgacgcagtaggtaatgctgtgaagatggctaaccaggcgaacatcccggttatcactcttgaccgccaggcaacgaaaggtgaagtggtgagccacattgcatctgataacgtactgggcggcaaaatcgccggtgattacatcgcgaagaaagtgggtgaaggtgccaaagttatcgagctgcaaggtattgccggtacatccgcagcccgtgaacgtggcgaaggtttccagcaggccgttgctgctcacaagtttaatgttcttgccagccagcctgcagattttgatcgcaccaaaggtttgaacgtaatgcagaacctgttgaccgctcatccggatgttcaggctgtattcgcgcagaatgatgaaatggcgcttggcgcgctgcgcgcactgcaaactgccggtaaatcggatgtgatggtcgtcggatttgacggtacaccggatggcgaaaaagcggtgaatgatggcaaactagcagcgactatcgctcagctacccgatcagattggcgcgaaaggcgtcgaaaccgcagataaagtgctgaaaggcgagaaagttcaggctaagtatccggttgatctgaaactggttgttaagcagtagttttaatcaggttgtatgacctgatggtgacataaatacgtcatcgacagatgaacgtgtaatataaagaaaagcagggcacgcgccaccctaacacggtggcgcattttatggacatcccgaatatgcaaaacgcaggcagcctcgttgttcttggcagcattaatgctgaccacattcttaatcttcaatcttttcctactccaggcgaaaccgtaaccggtaaccactatcaggttgcatttggcggcaaaggcgcgaatcaggcggtggctgctgggcgtagcggtgcgaatatcgcgtttattgcctgcactggcgatgacagcattggtgagagcgttcgccagcagctcgccactgataacatcgatatttctccggtcagcgtgatcaaaggcgaatcaacaggtgtggcgctgatttttgttaatggcgaaggtgagaatgtcatcggtattcatgccggcgctaatgctgccctttccccggcgctggtggaagcgcaacgtgagcgtattgccaacgcgtcagcattattaatgcagctggaatcaccactcgaaagtgtgatggcagcggcgaaaatcgcccatcaaaataagactatcgttgcgcttaacccggctccggctcgcgaacttcctgacgaactgctggcgctggtggacattattacgccaaacgaaacggaagcagaaaagctcaccggtattcgtgttgaaaatgatgaagatgcagcgaaggcggcgcaggtactgcatgaaaaaggtatccgtactgtactgattactttaggaagtcgtggtgtatgggctagcgtgaatggtgaaggtcagcgcgttcctggattccgggtgcaggctgtcgatactattgctgccggagatacctttaacggcgcgttaatcacgtcgttgctggaagaaaaaccattgccagaggcgattcgttttgcccatgcagccgctgcgattgccgtaacacgtaaaggcgcacaaccttccgtaccgtggcgtgaagagatcgacgcatttttagacaggcagaggtgacgcttggctacaatgaaagatgttgcccgcctggcgggcgtttctacctcaacagtttctcacgttatcaataaagatcgcttcgtcagtgaagcgattacagccaaagttgaagcggcgattaaagaactcaattacgcgccatcagctctggcgcgtagcctcaaactcaatcaaacacataccattggcatgttgatcactgccagtaccaatcctttctattcagaactggtgcgtggcgttgaacgcagctgcttcgaacgcggttatagtcttgtcctttgcaataccgaaggcgatgaacagcggatgaatcgtaatctggaaacgctgatgcaaaaacgcgttgatggcttgctgttactgtgcaccgaaacgcatcagccttcgcgtgaaatcatgcaacgttatccgacagtgcctaccgtgatgatggactgggctccgttcgatggcgacagcgatcttattcaggataactcgttgctgggcggagacttagcaacgcaatatctgatcgataaaggtcatacccgtattgcctgtattaccggtccgctggataaaactccggcgcgcctgcggttggaaggttatcgggctgcgatgaaacgtgcgggtctcaacattcctgatggctatgaagtcactggtgattttgaatttaacggcgggtttgacgctatgcgccaactgttatcacatccgctgcgtcctcaggccgtctttaccggaaatgacgctatggctgttggcgtttaccaggcgttatatcaggcagagttacaggttccgcaggatatcgcggtgattggctatgacgatatcgaactggcaagctttatgacgccaccattaacaactatacaccaaccgaaagatgaactgggggagctggcgattgatgtactcatccatcggataacccagccgaccctacagcaacaacgattacaacttactccgattctgatggaacgtggttcggcttagatttacgctgtcttttgatcaaattattaccatcggttgttttcagtagcatgaacattgcagctgaagcaacagtaataatgcccatcgtgataaacgtatagtggaattgttcgactgtcgttgtgccttccatcccttcgtaaacgcgaaggactgccgcacttacagcaacgcctaaactgatcgacagttgctgcgtgaccgccagaacactgttaccgctgctggcgttgtcatcggtcagatcggcaagtgtgatggtattcatcgcggtaaattgtgtcgacatagccatccctaatataaacaacggcaagatcagcatccatatcgccattgctggtgattgcaaagagaactgagcgatcattagccctataatcaccgtgatccccactaacgtatggcgatagcccagacgacgtaagacttgggtaaccatcgattttgcaataatggaacctaacgctgtcggtgccatcatacagccagcaataaacgcctgatacccaaatcctacctgtaacatcaatggcataaggaacggtacacagccggtccccagacgggttgcaatattgcctacgataccgatcgagaaagtgcgggttttaaataaatctaatgaaattaatgggtttggcgtgcgtcgcgcatggagaatatagagaagcagtaacccgatgctggtgacaattaccgtcaaggcaatccagctggcgacaatcttttccccgaatagctctattccgcttgagaagagaacaaggctgaggccaaacagcaaaaagccagtggtatcgaatctgcgtcgtgcggtggtgaaattgggcatatgtttgtgcgcgtaaagaaggcccgcaatacctatggggatattgattaaaaatatccagtgccaggttgcccaggtgaccagcccgccgccaagaacggggcctaaaattggccccaccagacccggcatggcgacaaaattcaatacaggaagaagctcattacgaggataagcgcgcagtaaggccagccgagcaacaggcatcatcattgcgccgcctatcccctgaataacccggaagacaaccagctgtggtagcgagttagaaagtgcgcaggccagagaacccaacgtgaacagactcacggcaagggtaaatatgcgacgcgtaccgaagcgatcggctagccatccgcttaccggaataagcatcgccaccgtcagcgtataactgatgatggctgattgcatcgcgagaggagaacgattaaggctatgagcgattgcgggtaaggcggtattcagaatagtggcatcaagtgcctgcatgaagaaggccatcgccgcgatccacggcaaacccgccatactgcgcttctttttatcgctcattcaatgtcctgttatcgggttatcacttatctggtgagcgtagcagcgcctgacaagctttaaatgccgcgtcgccatcgctttggataatcgcatcgacaatcgcctggtgcagatccagctttatcactgtgtcgctggtaattgacgtgaagtaagtgtgataaaccgaatggaatagcgaggcgaatgaggtcaaaaacggattggcgctcatttcatagatatgctcatgccaggccatatcgacttcgatccagcgttcacggcgaaagttctcttttaatgccgccatttcggccattaacgtattgagatgcgccttctgttccgcggtgccaacctttgctgccagtaggcaagcttgcggctccagacagatacgcataaccagaaagtgatcgatgacctgatgaaagttctcttctgtcatccaccaggtaagcaattcctgatcaagaaaattccagttcgattgtggcatgactcgggtaccaattcgcggtcgcggtaaaaccatcccttttgccgttaacgttttgaccgcttcgcgtaccgctgtacgactcactccaaattgctcgcccagctcaatctcaccaggcaaaatggtgccgggttcatattcaccttttaagatccgctgcgccagcttctcagccagaacatacgaaaggtttttctgtgcagctaactgttgtgcgcttaaaggcattactaatcttcctttttctttttattccttcttagtatgccaccaggaagtgtgattacggttgcaaaaacggcaaattgcttgttttatggcacattaacggggcttttgctgaaaaaatgcgcgatcagaaaattattttaaatttcctcttgtcaggccggaataactccctataatgcgccaccactgacacggaacaacggcaaacacgccgccgggtcagcgggattctcctgagaattccggcagagaaagcaaaaataaatgcttgactctgtagcgggaaagcgtattatgcacaccccgcgacgctgagaaaaagcgaagcggcactgctctttaacaatttatcagacaatctgtgtgggcactcgaagatacggattcttgacgtcgcaagacgaaaaatgaataccaagtctctgagtgaacacgtaattcattacgaagtttaattcacgagcatcaaacttttaaattgaagagtttgatcatggctcagattgaacgctggcggcaggcctaacacatgcaagtcgaacggtaacagaaagcagcttgctgctttgctgacgagtggcggacgggtgagtaatatctgggaaactgcccgatggagggggataactactggaaacggtagctaataccgcataacgtcgcaagaccaaagagggggaccttcgggcctcttgccatcggatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgtactttgaagtgctcacacagattgtctgatagaaagtgaaaagcaaggcgtcttgcgaagcagactgatacgtccccttcgtctagaggcccaggacaccgccctttcacggcggtaacaggggttcgaatcccctaggggacgccacttgctggtttgtgagtgaaagtcacctgccttaatatctcaaaactcatcttcgggtgatgtttgagatatttgctctttaaaaatctggatcaagctgaaaattgaaacactgaacaacgagagttgttcgtgagtctctcaaattttcgcaacacgatgatgaatcgcaagaaacatcttcgggttgtgaggttaagcgactaagcgtacacggtggatgccctggcagtcagaggcgatgaaggacgtgctaatctgcgataagcgtcggtgaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgcgcgatacagggtgacagccccgtacacaaaaatgcacatactgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcctcttaatggggtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacactatgtgttgttgggtaggggagcgttctgtaagcctgtgaaggtggcctgtgagggttgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaaccaaggctgaggcgtgatgacgaggcactacggtgctgaagcgacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagcggcaacgcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttggcccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagacttagagtctcctgaaggaacgttgaagacgacgacgttgataggccgggtgtgtaagcgcagcgatgcgttgagctaaccggtactaatgaaccgtgaggcttaaccttacaacgccgaagatgttttggcggatgagagaaagattttcagcctgatacagattaaatcagaacgcagaagcggtctgataaacagaatttgcctggcggccttagcgcggtggtcccacctgaccccatgccgaactcagaagtgaaacgccgtagcgccgatggtagtgtggggtctccccatgcgagagtagggaactgccaggcatcaaatttagcagtaagccggttataaaccggtggttgtaaaagaattcggtggagcggtagttcagtcggttagaatacctgcctgtcacgcagggggtcgcgggttcgagtcccgtccgttccgccaccctaattaggggcgtagttcaattggtagagcaccggtctccaaaaccgggtgttgggagttcgagtctctccgcccctgccagaaatcatccttagcgaaagctaaggattttttttatctgaaataaccctctccgaagtaactccttctaccggcatccttgccagccattcagattaatacacttcatccagcacgttaattttcaatagatcgcgaatcaacgcatttttatcgctattttgtagccatatggcataaagcggccgtgaaagtgttgtgctatcgacaacggtatgcaggccgccttttttacgtgcccaactgacgggtagccaggtgcaaccattaagcatcgcaatctgttgctgtgccagttcagcagaactggttgtcagaatgggaacttcgtcagcaccgatcaaacctgcctcatgctgttgaaaatctggcccccactctagtcgcagatagttaagatctccctttagtttagaaggggcactggtataaagcgctaaagtgaaataccccagcaactgactacaaaattcgtccattttgggggcttcagttgtaataagaagatcaagctggcgttcatgcaactgttttaccagagactgccgttgggcaattcgcgcttcgaactgtaagcctgtatggacatcctgattttgatacaagcgtcccagccactgattaagcatacactcccacagcgaggcgctggcaccgatagaaaactcattatgtcgtgaggtatgcgccacctccttgcgggcggcctgccaggtgctcatgagcgtttctgcataaggcagaagcttttctccggcagcggttaaacggatattgtttctgtggcgggtgaaaagattcacacccagttgattttccagttgtctgattcgaaagctcacggctgattgggtcagatagagcgattcagccgctcgaccaaagtgacgcgttcggctaacttccaggaaagtttttaacaattccgtatccacagtgctctccgcaaaattatttgtcgttatgatttaaatgttttgttttacactctgtcaagcgtaactaatactccgcgccataactagctcggtcaaagaattaggagcgtgcaggatggcggaaagctttacgacgactaatcgatatttcgacaataaacattatccacgtggattctctcgtcatggtgacttcaccatcaaagaggcacaactgcttgagcgtcatggttatgccttcaatgagttggatcttggcaaacgcgagccggttaccgaggaagagaaactcttcgtagcagtatgccgtggcgaacgtgaaccagtgacagaagcagaacgcgtgtggtccaagtatatgacgcgtatcaagcgtccaaaacgttttcacaccctttccggcggtaaaccgcaggttgaaggtgctgaagactacaccgattctgacgattaataaaaagggcgaaatgccctttttttatgtcagtagtttttgcagatggatgagcaaacggtcaatcgcacgatagctaactgcctcctgcaaatgctgacgtgtgataatgtcagactgatcaatatcagcaatggttcgtgcaactttcaataaccgctgccaggcacgaatcgataaccccagatggatcagcgtttcttccagccactgcgcatcttcgctttcaagcttgcagaattggcgtatttccggattatccagccaggcgttcagtttattctgccgcttaaattggcgctctctggcggccattacacgttgtttaacggtggtgctgttttctcccggcactaccgttttactcaaaatgccggggggcggtaatgggatctccagtgagagatcgaagcggtcgagaaagggccccgagagccggttgagataacgtaatgtctgttctggtgtgcagcggttatggtttccctgataatgtccggtagggctgggattcatcgccgcgacaagctggaaacgggctggataggttatttttgctcgtgtgcgtgaaagatggatctgcccggattcaatcggctctcgcaaggcatccagtgtacgccgttcaaattcaggtagctcatcaagaaaaagcacgccgttatgcgccagcgaaatttcacctggccctggaattgcaccaccgcccaccatcgcagttaacgacgcactgtgatgaggtgagcggaacgggcgctgccgccattgtttttgtactgattcagcatttaccagacttaatatcgcagcgctctccagtgcctcttcattgcttaaatctggcaaaaggccattaatacggctggcgagcattgttttacctgttcccggcggtccaatcagtaaaaggttgtgcccgccagcggcggtaatttccagtcctcgctttccttgctcctgaccgacaacatcactgagatcatgttgtagcgcccgggatactgcattagttggtttcgggtgttcgagagcgtgcttaccttccagaaacgcgcagacagcctgcagatgatcggctatcaggcatccttcaccgttaattagccccacttcatcttcgttatctttcgcgacgataatttttctgcccgacttaatagcttcagttgcactggagattgcgccgggaacgccacgcagagcgcctgtaagcgccagttctccgactaattcatattcatctaacttattggctgtaagctgttctgaggccgccagtaacgcaatagcgataggcaaatcatatcgtcccccttcttttggcagatcggctggagcaaggttgatggtgatttttttcgccggatattcatatccgctattgataatggcgctgcgcacgcgatcgcgagcttcttttaccgttgtttctggtaagcccaccatcgttaagcctggtagacctttactgatatgtacctcaacagtgattgggggcgcatttactcccagggctgcgcgggtatgaacaattgacagtgacataagccctccttgagtcaccattatgtgcataagatatcgctgctgtagcccgctaattcgtgaattttagtggctgattcctgtttatttgtgcaagtgaagttgagttgttctggcggtggaatgatgctcgcaaaaatgcagcgtgcaaaggatgaactacgaggaagggaacaacattcatactgaaattgaatttttttcactcactattttctttttaaaaaacaacaatttctcttgaaattattaaagacatcataaaaatcggccaaaaaatatcttgtgctattcgcaaaatctatggtaactctttaggcattccttcgaacaagatgcaagaaaagacaaaatgacagcccttctacgagtgattagcctggtcgtgattagcgtggtggtgattattatcccaccgtgcggggctgcacttggacgaggaaaggcttagagatcaagccttaacgaactaagacccccgcaccgaaaggtccgggggttttttttgaccttaaaaacataactgaggagcagacaatgaataacagcacaaaattctgtttctcaagattcaggacggggaactaactatgaatggcgcacagtgggtggtacatgcgttgcgggcacagggtgtgaacaccgttttcggttatccgggtggcgcaattatgccggtttacgatgcattgtatgacggtggcgtggaacacttgctgtgccgacacgagcaaggtgcagcaatggcggctatcggttatgcccgtgctaccggcaaaactggcgtttgcatcgccacgtctggtccaggtgcaaccaacctgataaccgggcttgcggacgcgctgttagattccatccccgttgttgctatcaccggtcaggtatccgcaccgtttatcggcactgacgcatttcaggaggtggatattctggggttgtcgttagcctgcaccaagcacagtttcctggtgcaatcactggaagagttaccgcgtatcatggccgaagcgtttgacgtcgccagctctggtcgtcctggtccggttttggtcgatattccaaaagatatccagttagccagcggcgatctggaaccgtggttcaccactgttgaaaacgaagtgactttctcacatgccgaagtcgagcaagcgcgtcagatgctggcaaaagcgcaaaaaccgatgctgtacgttggcggtggcgtgggcatggcgcaggcagtttcggctttgcgtgaatttctcgctgccacaaaaatgcctgccacctgtacgttgaaagggctgggcgcagtagaagcagattatccgtactatctgggcatgctggggatgcacggcaccaaagcggcgaacttcgcagtgcaggagtgcgatctactgatcgccgtgggcgcacgttttgatgaccgggtgaccggcaaactgaacaccttcgcaccacacgccagcgttatccatatggatatcgatccggcagaaatgaacaagctgcgtcaggcacatgtggcattacagggtgatttaaatgctctgttaccagcattacagcagccgttaaatatcgatgactggcagcaacactgcgcgcaactgcgtgatgaacatgcctggcgttacgaccatcctggtgacgctatctacgcgccgttgttgttaaaacaactgtcggatcgtaaatctgcggattgcatcgtgaccacagatgtggggcagcaccagatgtgggctgcccagcacatcgtccacactcgcccggaaaacttcatcacctccagcggcttaggcaccatgggtttcggtttaccggcggcggttggcgcacaagtcgcgcgaccgaacgatactgtcgtctgtatctccggtgacggctctttcatgatgaatgtgcaagaactgggcaccgtaaaacgcaagcagttaccgttgaaaatcgtcttactcgataaccaacggttagggatggttcgacaatggcagcaactgtttttccaggaacgatacagcgaaactacccttaccgataaccccgatttcctcatgttagccagcgccttcggcatccctggccaacacatcacccataaagaccaggttgaagcggcactcgacaccatgctgaacagtgatgggccatacctgcttcatgtctcaatcgacgaacttgagaacgtctggccgctggtgccgcctggtgccagtaattctgaaatgttggagaaattatcatgatgcaacatcaggtcaatgtatcggctcgcttcaatccggaaaccttagaacgtgttttacgcgtggtgcgtcatcgtggtttccacgtctgctcaatgaatatggccgccgccagcgatgcacaaaatataaatatcgaattgaccgttgccagcccacggtcggtcgacttactgtttagtcagttaaataaactggtggacgtcgcacacgttgctatctgccagagcacaaccacatcacaacaaatccgcgcctgagcgcaaaaggaatataaaaatgaccacgaagaaagctgattacatttggttcaatggggagatggttcgctgggaagacgcgaaggtgcatgtgatgtcgcacgcgctgcactatggcacctcggtttttgaaggcatccgttgctacgactcgcacaaaggaccggttgtattccgccatcgtgagcatatgcagcgtctgcatgactccgccaaaatctatcgtttcccggtttcgcagagcattgatgagctgatggaagcttgtcgcgacgtgatccgcaaaaacaatctcaccagcgcctatatccgtccgctgattttcgtcggtgatgttggcatgggcgtaaacccgccagcgggatactcaaccgatgtgattatcgccgctttcccgtggggggcgtatctgggcgcagaagcgctggagcaggggatcgatgcgatggtttcctcctggaaccgtgctgcaccaaacaccatcccaaccgcagcgaaagctggaggtaactacctctcttccctgttggtgggtagcgaagcgcgccgccacggttatcaggaaggtatcgcattggatgtgaatggttatatctctgaaggcgcaggagaaaacctgtttgaagtgaaagacggtgtgctgttcactccaccgttcacctcctccgcgctgccgggtattacccgtgatgccatcatcaaactggcgaaagagctgggaattgaagtgcatgaacaggtgctgtcgcgcgaatccctgtacctggcggatgaagtctttatgtccggtacggcggcagaaatcacgccagtgcgcagtgtagatggtattcaggttggtgaaggccgttgcggcccggttaccaaacgcattcagcaagccttcttcggcctcttcactggcgagaccgaagataaatggggctggttagatcaagttaatcaataaatacaaaaaatgggacggcacgcaccgtcccatttacgagacagacactgggagtaaataaagtatgcctaagtaccgttccgccaccaccactcatggtcgtaatatggcgggtgctcgtgcgctgtggcgcgccaccggaatgaccgacgccgatttcggtaagccgattatcgcggttgtgaactcgttcacccaatttgtaccgggtcacgtccatctacgcgatctcggtaaactggttgccgaacaaattgaagcggctggcggcgttgccaaagagttcaacaccattgcggtggatgatgggatcgctatgggccacgggggcatgctttattcactgccatctcgcgaactgatcgctgattccgttgaatatatggtcaacgcccactgcgccgacgccatggtctgcatctctaactgcgacaaaatcaccccggggatgctgatggcttccctgcgcctgaatattccggtgatctttgtttccggcggcccgatggaggccgggaaaaccaaactgtccgatcagatcattaagctcgatctggttgatgcgatgatccagggcgcagacccgaaagtttctgactcccagagcgatcaggttgaacgatccgcctgcccaacctgcggttcctgctccgggatgtttactgctaactcaatgaactgcctgaccgaagcgctgggcctgtcgcagccgggcaacggctcgctgctggcaacccacgctgatcgcaagcaactgttcctcaatgctggtaaacgcattgttgaattgaccaaacgttactacgaacaggatgatgaaagcgcactgccgcgtaacatcgccagtaaggcggcgtttgaaaacgccatgacgctggatatcgcgatgggcggctctaccaacaccgttctccacctgctggcggcggcgcaggaagcggaaatcgacttcaccatgagtgatatcgataagctctcccgcaaagtaccgcagctgtgtaaagttgcgccgagcacccaaaaataccatatggaagatgttcaccgtgctggtggtgttatcggtattctcggcgagctggatcgtgcggggttactgaaccgtgatgtgaaaaatgtacttggcctgacgttgccgcaaacgctggaacaatacgacatcatcgtgacccaggatgatgcggtaaaaaatatgttccgcgctggcccggcgggcattcgtactacacaggcattctcgcaggattgccgctgggatacgctggacgacgatcgctccaatggctgtatccgctcgctggaacacgcctacagcaaagacggcggcctggcggtgctctacggtaatttcgcagaaaacggctgcatcgttaaaaccgcaggcgtcgatgacagcatcctcaaattcactggcccggcgaaagtctacgaaagccaggacgacgcggtagaagcgattctcggcggtaaagttgtcgccggagatgtggtagtaattcgctatgaaggcccgaaaggcggtccggggatgcaggaaatgctctacccaaccagtttcctgaaatcaatgggtctcggtaaagcctgtgcgctgatcaccgacggtcgtttctctggcggcacctctggtctttccatcggccacgtctcaccggaagcggcaagtggcggcagcattggcctgattgaagatggtgacctgatcgctatcgacattccgaaccgtggcattcagttacaggtaagcgatgccgaactggcggcgcgtcgtgaagcgcaggaagctcgtggcaacaaagcctggacaccgaaaaatcgtgaacgtcaggtttcctttgcgctgcgtgcctacgccagcctggcaaccagcgccgacaaaggcgcggtgcgtgataaatcgaaactggggggttaatgatggcagactcacaacctctctccggcgccccggaaggcgccgaatatttaagagcggtgctgcgcgcgccggtctacgaagcggcgcaggtcacgccgctacaaaaaatggaaaaactctcgtcgcgtctcgataacgtgattctggtgaaacgcgaagaccgtcagccagtgcacagctttaagctgcgcggcgcatacgccatgatggcgggcctgacggaagaacagaaagcgcacggcgtgatcaccgcttctgcgggtaaccacgcgcagggcgtcgcgttttcttccgcacggttaggcgtgaaggcactgatcgtcatgccaaccgccaccgccgatatcaaagtcgacgcggtgcgcggcttcggcggcgaagtgcttcttcacggcgcgaactttgatgaagcaaaagcgaaagcgatcgaactatcacagcagcagggcttcacctgggtgccgccgttcgaccatccgatggtgatcgccgggcaaggcacgctggcgctggaactgctccagcaggacgcccatctcgaccgcgtatttgtgccagtcggcggcggcggtctggcggcgggcgtggcggtactgatcaaacaactgatgccgcaaatcaaagtgattgccgtggaagcggaagactccgcctgcctgaaagcggcgctgaatgcaggtcatccggttgatctgccacgcgtggggctgtttgccgaaggtgttgcggtgaaacgcatcggcgacgaaaccttccgtttatgccaggagtatctcgacgacatcatcaccgtcgatagcgatgccatatgtgcggcgatgaaagacctgttcgaagatgtgcgcgcggtggcggaaccctctggcgcgctggcactggcgggaatgaaaaaatatatcgcccagcacaacattcgcggtgagcggctggcgcatattctttctggtgctaacgtgaactttcacggcctgcgctacgtctcggaacgttgcgaactgggcgaacagcgtgaagcgttgctggcggtaaccatcccggaagagaagggcagcttcctgaagttctgccagctgcttggcgggcgctcggtcaccgagttcaactaccgttttgccgatgccaaaaacgcctgcatttttgttggtgtgcgcctgagccgtggtctcgaagagcgcaaagaaattttgcagatgctcaacgatggcggctacagcgtagtggatctctccgacgacgaaatggcgaagctgcatgtgcgctatatggtcggcgggcgtccgtcgcatccgttgcaggaacgcctctacagcttcgaattcccggaatcgccgggcgcgctgttgcgcttcctcaacacgctgggtacgcactggaacatttctttgttccactatcgcagccatggcaccgactacgggcgcgtactggcggcgttcgagcttggcgatcatgaaccggattttgaaacccggctgaatgaactgggctacgattgccacgacgaaaccaataacccggcgttcaggttctttttggcgggttagtggttcggcaaaatcttccagaacgcctcaatcagcggctcatgtagccgctttttctgcacacacacgcccagttcaaacggcgttttttcatcactgcgctctaaaatcatcacgcggttacgcactggttccgggctgttttccagcaccacttccggcaacaaggccacgccacagccgagcgctaccatcgacaccatcgcttcatgcccgccgaccgtggcgtaaatcatcgggttgctgattttgttgcgtcgaaaccacagttcaatgcgccggcgcaccggtccctgatcggccatgataaacggcactgtagaccagtccggcttctctgccgaaacttggttacgcaccgggcagggtagcgcgggggcaatcagcactactgccagattctccagcatcgaaaacgccactgcgccgggcagagtctccggtttcccggcaatcgccagatccgcttcgccagtgactaccttttccatcgcatctgccgcatcaccagtcgtgagtttaatctccaccgacgggtgttccgcgcggaagcgatcgagaatcggcggcagatggctgtaggcagcggtcaccgagcagaagatatgtaattcgccagagagcgacggtccttgctgatcgatggtgtggcgcagctgttgatactgcaacagcgtttgctgggcgaaaacgcgcagttcttcgcctgcttcggttagcgttaccgtgcggttatcgcgcacaaacagcggctgaccgagatcgtcttccaggcgctgaatctgccgagagagcgtggacgggctaacgtgcattgcccgcgcgctgcggccaaaatggcggctttccgccagatgcaggaaggttttcagatcgcgtaaatccaatggcgcagccctcaatgttgacgttgcaaaaattgcaatgtgacgttgtgaatatatcaatttccgcaataaatttcctgtcatatagtgaattcaatctcgcaaacgcgaaccgaacaataagaagcacaacatcacgaggaatcaccatggctaactacttcaatacactgaatctgcgccagcagctggcacagctgggcaaatgtcgctttatggggcgcgatgaattcgccgatggcgcgagctaccttcagggtaaaaaagtagtcatcgtcggctgtggcgcacagggtctgaaccagggcctgaacatgcgtgattctggtctggatatttcctacgctctgcgtaaagaagcgattgccgaaaagcgcgcatcctggcgtaaagcgaccgaaaacggttttaaagtgggtacttacgaagaactgatcccacaggcggatctggtggttaacctgacgccggacaagcagcactctgatgtagtgcgcaccgtacagccactgatgaaagacggcgcggcgctgggttactcgcatggtttcaacatcgtggaagtaggcgagcagatccgtaaagacatcaccgtagtaatggttgcgccgaaatgccctggcaccgaagtgcgtgaagagtacaaacgtggattcggcgtaccgacgctgattgccgttcacccggaaaacgatccgaaaggcgaaggcatggcgatcgctaaagcgtgggcggcggcaaccggtggtcatcgtgcgggcgttctggaatcctctttcgttgcggaagtgaaatctgacctgatgggcgagcaaaccatcctgtgcggtatgttgcaagctggttctctgctgtgcttcgacaagctggtggaagaaggcaccgatccggcatacgcagaaaaactgattcagttcggttgggaaaccatcaccgaagcgctgaaacagggcggcatcaccctgatgatggaccgtctttctaacccggcgaaactgcgtgcttacgcgctttctgagcaactgaaagagatcatggcgccgctgttccagaaacatatggacgacatcatctccggcgaattctcctccggcatgatggctgactgggccaacgacgataagaaactgctgacctggcgtgaagagactggcaaaaccgcattcgaaaccgcgccgcagtatgaaggcaaaatcggtgaacaggagtacttcgataaaggcgtactgatgatcgcgatggtaaaagcaggcgttgagttggcgtttgaaaccatggttgattccggcatcatcgaagaatctgcttactatgaatcactgcacgaactgccgttgattgccaacaccatcgcccgtaagcgtctgtacgaaatgaacgtggttatctccgatactgccgagtacggtaactatctgttctcttacgcttgtgtgccgctgctgaaaccgtttatggcagagctgcaaccgggcgacctgggtaaagctattccggaaggtgcggtagataacgcgcagctgcgtgatgtaaatgaagcgattcgcagccatgcgattgagcaggtaggtaagaaactgcgcggctatatgacggatatgaaacgtattgctgttgcgggttaatagcgattcagagttcaaggccttctcccggagaaggccttgctgttagttacggtacagcaccttaatgatgtggtaaccgaactgggtatgcagcgggccggttggctccagtaccggacaagagaaaaccactttatcgaacgccggaaccatttgaccctggcggaattcacccaaatcaccgccgcgtttgcctgacgggcaaatggagtgtttcttcgccagcttgccgaaatcggcaccgttcttgatctgctcgagaagatccagagccagtttctcttcttttacaaggatatgcagtgctgctgctgttttttccatgatcgtgccttgagtggtaaggatgaggctggctatactaccacgctgttattttcccctcccgactttcattgagcgattttcctatgcgtctaaaccccggccaacaacaagctgtcgaattcgttaccggcccctgcctggtgctggcgggcgcgggttccggtaaaactcgtgttatcaccaataaaatcgcccatctgatccgcggttgcggttatcaggcgcgacatatcgcggcggtgacctttaccaataaggcggcacgcgagatgaaagagcgtgtcgggcagacgctggggcgcaaagaggcgcgtgggctgatgatctccaccttccacacgctggggctggatatcatcaaacgcgagtatgcggcgctggggatgaaggctaacttttcgctgtttgacgataccgatcagcttgctttgcttaaagagttgaccgaggggctgattgaagatgacaaagttctcctgcaacagctgatttcgaccatctccaactggaagaacgatctcaaaacaccggcgcaggcggcggcagaggcaaagggcgagcgggaccgtatttttgcccattgttatgggctgtatgatgcacacctgaaagcctgtaacgttctcgacttcgatgatctgattttattgccgacgttgctgctgcaacgcaatgaagaagtccgcgagcgctggcagaacaaaattcgctacctgctggtggatgagtatcaggacaccaacaccagccagtatgaactggtgaaactgctggtgggcagccgcgcgcgctttaccgtggtgggtgacgatgaccagtcgatctactcctggcgcggcgcacgtccgcagaatctggtgctgctgagccaggattttccggcgctgaaggtgattaagcttgagcagaactaccgctcttccggacgtattttgaaagcggcgaacatcctgatcgccaataacccgcacgtctttgaaaagcgtctgttctccgaactgggttacggcacagagctaaaagttttaagcgcgaataacgaggaacatgaagccgagcgcgtcaccggcgagctgatcgcccatcacttcgtcaataaaacgcagtacaaagattacgccattctttatcgcggcaaccatcagtcgcgggtatttgaaaaattcctgatgcaaaaccgcatcccgtacaaaatttctggtggtacgtcgtttttctctcgtcctgaaatcaaggacttgctggcttatctgcgcgtgctgactaacccggacgatgacagcgcatttctgcgtatcgttaacacgccgaagcgagagattggcccggcgacgctgaaaaagctaggtgaatgggcgatgacgcgcaataaaagcatgtttaccgccagctttgatatgggcctgagtcagacgcttagcggacgtggttatgaagcattgacccgcttcactcactggctggtagaaatccagcgtctggcggagcgggagccgattgccgcggtgcgcgatctgatccacggcatggattatgaatcctggctgtacgaaacatcgcccagcccgaaagctgccgaaatgcgcatgaagaacgtcaaccaactgtttagctggatgacggagatgctggaaggcagcgaactggatgagccgatgacgctcacccaggtggtgacgcgctttactctgcgcgacatgatggagcgcggcgagagcgaggaagagctggatcaggtgcaactgatgactttgcacgcgtcaaaaggactggagtttccctatgtctacatggttggtatggaagaaggatttttgccccaccagagcagtatcgatgaagataatatcgatgaggagcggcggctggcctatgtcggcattacccgcgcccagaaggaattgacctttacgctgtgtaaagaacgccgtcagtacggcgaactggtgcgcccggagccgagccgcttcctgctggagctgccgcaggatgatttgatttgggaacaggagcgcaaagtggtcagcgccgaagaacggatgcagaaagggcaaagccatctggcgaatctgaaagcgatgatggcggcaaaacgagggaaataatcaaggccggaaaagatgtgtcagcatcgcatccggcacttactcattaatgcacttccagcggccagtggacatagctctgccactggctttcctgatcaataatctctttacccagcggatgttgggttagccaaccttgcggaagcgtcaaggtcaacagttcatggttagcctgtaatgtcatctctggcacgagatcgtcacggcgacggctggcaaaaatgatagccaggcggagtaaacggcagagttgttctgcgacgcgcggtggtacggcattttgctgatgcagcgatgagagatcgaccggattagtctggttgagcagtagcgtcgccagcagttttttctgtgcgggggtaaaaccgggaagatccagattacgtaccagataagcagcgtgttgcggcgcttgtttgaagtcaacgctcaggccgatttcatgaagctgacaggcgctgatgagcaaatcgcggcttattgcttcaagatgccattcattttccacctgatcgtagaagttagccgcaactttggctacgcgctgtgcctgatcaatatcgatcataaagcggcgctgaatattacgcagcgtacggctgcgaatatcctgctcgacggtaagatgcaacataccgtagaccaggccttcacgcagcgcaccgcccgccagggtcatacactgaatattcagttcggtaaaaatggctatcaggatcgccagaccactcgggaacactaacgcacgttccagcgtcagcccgtcaatctctagctcttccagccgaccgcaatgaatggcgcgttgtttcagttgctgcaacttttccagggtaatgcgttcatccatcccctgtgccatcatgatttcctgtaacgcctgcacggtgccggaagcgccaacgcacactttccagccgtgataccgtaattcatcggcaaccggacgtaacacttcgcgtgccgctttttctgcagcatcaaaattttcctgccccagattacgatcggcaaaatagcgttccagccaggtaacgcagcccatcgacaggctgaacaaagaggtggtttgtgcacccgtgccggttaccagttcagtactggctccgccgatatccaccaccaggcgctgatcggcaccgccagtggtgtgagcaacgccctgataaatcagacgcgcttcctcttcaccgctgatcacctgtaccggacaaccgaggatttcctgcgctttggcaataaaatcacccgcattgacggcaaggcgtaatgtcgccgtagcgacaacgcgaatttgtgagggagggatatcttgcagacgttcagcaaacaggcgcagacattgccaaccacgctccattgcttcattagacagggcattttcgctattcaggccagcagccagacgcactttgcgttttattcgcgtcagcgtctggatgcttccagccacctcgcgcacaaccagcatatgaaaactattcgaaccgagatcaatggctgcatacagcgacgaggtggagcccatactcttcatccttcaatctgtctctgcgttggctgcattctttcacctgaatcacttacgacagtaaactcatcgggattcattctcttgccatcttgatacagcttgaatgatttggagtatgacattttttctttaacctgaacgacgacgattacgcggagcgccagtacgacgcggaccattgcctgtgcgcgggcgcgtgaggcgcagcggttttggcagatcggtcatcaatgcgtccggattgtatttacttaccggaattgagtgaccaatataggtctcaatagcaggcaaattcaatgcatactcttcacacgccaggctaatagagtgaccgcttgcgcctgcgcgacctgttcgaccaatacggtgaacgtaatcttcacagtcatcgggtaaatcgtagttaaagacgtgtgtcacagcaggaatatgcaaaccacgcgcggcaacgtcggtggcaaccagaatatccagatccccacgggtaaattcatcaagaatacgcagacgttttttctgcgcgacatcgcctgtcaataaaccgacacgatgaccatctgccgccaggtggccccagatctcttcacaacggtgtttggtgttggcgaaaataatcgctctgtctggccactcttcttcgatcagcgtttgcagcaaacgcattttttcttcgttagaagggtagaaaagctcttctttaatacgatggcccgttttctgttccggttccacttcaatatattcggcattgttcatctgctcgaacgccagttcacgtacccggtacgaaagcgtggcggagaacagcatgttgaggcgctggtttgcaggcggcatacggcggaacagccagcggatatctttaataaagcccagatcgtacatgcgatcggcttcgtccagtaccaccacctgaatggcaccgaggttaatgtggttctgcttggcgtagtcaattaaacgacccgtggtgccaatcagaatgtcaacgccgctttccagcactttcagctgtttgtcgtagccatcaccaccgtaagccagacccagcttcaggccagtagcttccgccagcggttccgcgtcggcgtggatctgcacggcaagttcacgcgtcggtgccataattaaggcacgcggttgattcactttgcgatcggcaatcgcgggatgagagagaagataatgaaacgttgacgtaagaaacgccatcgttttcccggtaccggtttgcgcctgcccggctacgtcacgacccgccagcgtcagcggaagggccagtgcctgaatgggcgtacagttatgaaacccttttttttcaagggcttctacaaccttcggatgcagggcgaagtcggaaaacttctgttctgttaaatgtgttttgctcatagtgtggtagaatatcagcttactattgctttacgaaagcgtatccggtgaaataaagtcaacctttagttggttaatgttacaccaacaacgaaaccaacacgccaggcttattcctgtggagttatatatgagcgataaaattattcacctgactgacgacagttttgacacggatgtactcaaagcggacggggcgatcctcgtcgatttctgggcagagtggtgcggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggcgcactgtctaaaggtcagttgaaagagttcctcgacgctaacctggcgtaagggaatttcatgttcgggtgccccgtcgctaaaaactggacgcccggcgtgagtcatgctaacttagtgttgacttcgtattaaacataccttattaagtttgaatcttgtaatttccaacgcttcccgttttatcttaaatgcgaagtgaacagatttctggctcgtcactcaatccgtcttgtcgtttcagttctgcgtactctcctgtgaccaggcagcgaaaagacatgagtcgatgaccgtaaacaggcatggatgatcctgccataccattcacaacattaagttcgagatttaccccaagtttaagaactcacaccactatgaatcttaccgaattaaagaatacgccggtttctgagctgatcactctcggcgaaaatatggggctggaaaacctggctcgtatgcgtaagcaggacattatttttgccatcctgaagcagcacgcaaagagtggcgaagatatctttggtgatggcgtactggagatattgcaggatggatttggtttcctccgttccgcagacagctcctacctcgccggtcctgatgacatctacgtttcccctagccaaatccgccgtttcaacctccgcactggtgataccatctctggtaagattcgcccgccgaaagaaggtgaacgctattttgcgctgctgaaagttaacgaagttaacttcgacaaacctgaaaacgcccgcaacaaaatcctctttgagaacttaaccccgctgcacgcaaactctcgtctgcgtatggaacgtggtaacggttctacggaagatttaaccgctcgcgtactggatctggcatcacctatcggtcgtggtcagcgtggtctgattgtggcaccgccgaaagccggtaaaaccatgctgctgcagaacattgctcagagcattgcttacaaccacccggattgtgtgctgatggttctgctgatcgacgaacgtccggaagaagtaaccgagatgcagcgactggtaaaaggtgaagttgttgcttctacctttgacgaacccgcatctcgccacgttcaggttgcggaaatggtgatcgagaaggcgaaacgcctggttgagcacaagaaagacgttatcattctgctcgactccatcactcgtctggcgcgcgcttacaacaccgttgttccggcgtcaggtaaagtgttgaccggtggtgtggacgccaacgccctgcatcgtccgaaacgcttcttcggtgcggcgcgtaacgtggaagagggcggcagcctgaccattatcgcgacggcgcttatcgataccggttctaaaatggacgaagttatctacgaagagtttaaaggtacaggcaacatggaactgcacctctctcgtaagatcgctgaaaaacgcgtcttcccggctatcgactacaaccgttccggtacccgtaaagaagagctgctcacgactcaggaagaactgcagaaaatgtggatcctgcgcaaaatcattcacccgatgggcgaaatcgatgcaatggaattcctcattaataaactggcaatgaccaagaccaatgacgatttcttcgaaatgatgaaacgctcataaatttgtcttatgccaaaaacgccacgtgtttacgtggcgttttgcttttatatctgtaatcttaatgccgcgctggcgatgttaggaaaattcctggaatttgctggtgtgttatgcaatttgcatatcaagtagttaattttcgcatagtgctggtaggttcggaatggactttcctttctgaataaaggtcttcgtggttatacttctgctaataattttctctgagagcatgcattgtgaatttactgacagtgagtactgatctcatcagtatttttttattcacgacactgtttctgttttttgcccgtaaggtggcaaaaaaagtcggtttagtggataaaccaaacttccgcaaacgtcaccagggattgatacctctcgttggggggatttcggtttacgcagggatttgcttcacgttcggaattgtcgattactatattccgcatgcatctctctatctcgcttgtgctggtgtgcttgttttcattggcgcgctggatgaccgttttgatatcagcgtaaaaatccgtgccaccatacaggccgctgttggcattgttatgatggtgttcggcaaactttatctcagtagcctgggttatatctttggctcctgggagatggtgctcggaccgtttggttacttcctgacgctatttgccgtctgggcggccattaatgcgttcaacatggttgatggcattgatggcttgctgggcgggttgtcctgcgtctcgtttgcagcaatcggtatgattttgtggttcgacgggcaaaccagtctcgcaatctggtgctttgcgatgatcgccgccatcctgccatacatcatgcttaaccttggtatcctgggtcgccgctacaaagtctttatgggggatgcgggcagtacgctgattggttttaccgttatctggatcctgctcgaaacgacccagggcaaaactcatcccatcagcccggttaccgctttgtggataatcgccattccgctaatggatatggtggcgattatgtaccgtcgcctgcgtaaaggcatgagcccattctctccagaccgtcagcatattcaccatttgatcatgcgtgccgggtttacttcccgccaggcgtttgtgctgattacccttgccgcagcactgctcgcttccattggcgtgctggcagaatattctcattttgtcccggagtgggtcatgctggtgctctttttgctagcattcttcctctatggatattgcatcaagcgtgcctggaaagttgctcgctttattaagcgcgtaaaacgcagactgcgtagaaatcgtggtggcagccccaatttaaccaaataaatgaggatgtgatgacacaaccaatgcctgggaaaccggccgaagacgctgaaaatgaactggatattcgtgggttgtttcgtaccttgtgggctgggaagctgtggattattggcatggggctggcgtttgcgttaatcgcgctggcgtatactttttttgctcgccaggagtggagctcgacagcgattaccgatcgtccaacggtgaatatgctggggggatattactcacagcagcaatttttgcgtaacctggatgtccgttcaaacatggcttctgccgaccaaccatcggtcatggacgaagcttataaagagtttgttatgcaactggcctcgtgggatacccgcagagagttctggctgcaaaccgactattacaaacagcggatggtgggcaacagcaaagccgatgcggcgttgctggatgaaatgattaacaacatcgtgtttattcccggtgactttacccgcgcggtcaatgacagcgtgaagcttattgccgaaaccgcgcctgacgctaataacctgttacgtcagtatgttgcttttgccagccagcgtgcagccagccatctgaatgatgagctgaaaggcgcatgggcggcacgcaccatccagatgaaagctcaggtgaagcgtcaggaagaggtggcgaaagccatctacgatcgccggatgaacagtattgaacaggcgctgaaaattgctgagcagcataatatttcgcgcagtgcgacagatgtgcctgccgaggaattacctgattcagaaatgttcctgcttgggcgtccaatgctccaggctcgactggaaaatttacaggccgtcggtccggcctttgatctcgactatgatcagaatcgggccatgttaaacaccctgaatgttggtccaaccctggatccgcgttttcagacctatcgctatttgcgtacgccggaagaaccggtaaaacgcgatagcccacgtcgtgccttcctgatgattatgtggggcattgtcgggggactgatcggggctggtgtcgcattaacccgccgttgctcgaaatagcaacactgctgcggtgagcgcaaaggcgctcgccgcttattcgaagagaatcgatgtgaaagtactgactgtatttggtacgcgcccggaagccatcaagatggcgccgttggtgcatgcgttggcaaaagatcctttttttgaggctaaagtttgcgtcactgcgcagcatcgggagatgctcgatcaggtgctgaaactcttttccattgtacctgactacgatctcaacataatgcagccaggacagggccttacagagataacctgtcggattctggaagggctaaaacctattcttgccgagttcaaaccagacgtcgtgctggttcacggcgatactacgacgacgctggcaaccagcctggcggcgttttatcagcgtattcctgttggtcacgttgaggctggtctgcgcacgggcgatctctattcgccgtggccggaagaggctaaccgtacattgaccgggcatctggcgatgtatcatttttctccaaccgaaacttcccggcaaaacttgctgcgtgaaaacgttgcggatagccgaatcttcattaccggtaatacagttattgatgcactgttatgggtgcgtgaccaggtgatgagcagcgatacgctgcgttcagaactggcggcaaattacccgtttatcgatcccgataaaaagatgattctggtgaccggtcacaggcgtgagagcttcggtcgtggctttgaagaaatctgccatgcgctggcagacatcgccaccacgcaccaggacatccagattgtctatccggtgcatctcaacccgaacgtcagagagccggtcaatcgcattctggggcatgtgaaaaatgtcattctgatcgatccccaggagtatttaccgtttgtctggctgatgaaccacgcctggctgattttgaccgactcaggcggcattcaggaagaagcgccttcgctggggaaaccggtgctggtgatgcgcgataccactgagcgtccggaagcggtgacagcggggacggtgcgtctggtcggcacggataagcagcgaattgtcgaggaagtgacgcgtcttttaaaagacgaaaacgaatatcaagctatgagccgcgcccataacccgtatggtgatggtcaggcatgctctcgcattctggaagcgttaaaaaataatcggatatcactatgagttttgcgaccatttctgttatcggactgggttacatcgggctgcctacagcagctgcgtttgcctcaaggcaaaaacaggtgattggtgtcgatatcaaccaacacgcggttgataccatcaatcgtggcgaaatccatatcgtcgagcctgatttggcgagcgtagtaaaaactgccgtagaaggcggttttttacgagcgagcacgacgccagttgaagcggatgcctggttgattgctgtaccgacgccgtttaaaggcgatcatgagccagatatgacgtacgtcgaatcggctgcccgctccatcgcgccagtgttgaaaaaaggcgcgttggtgatccttgaatccacctcgccggtggggtcaaccgagaagatggcagaatggttagcagagatgcgtccagatctcactttcccacagcaggtgggcgagttggcggacgtcaacattgcttactgcccggaacgcgtattaccgggccaggttatggtcgagctgattaaaaacgatcgcgtgattggtggtatgacgccggtttgttcggcccgcgccagcgaactgtacaaaattttcctcgaaggtgagtgtgtcgtcactaactcgcggacggcagaaatgtgtaagctcaccgaaaacagcttccgcgatgtgaatatcgcttttgctaatgaattgtcgctgatttgtgccgatcaggggattaacgtctgggaactgattcgcctggcgaatcgtcaccctcgcgtcaatattcttcagccaggccctggcgtgggcggtcactgcatcgctgttgatccgtggtttatcgtggcacagaacccccagcaggcgcggcttatccgtaccgcgcgcgaagtgaacgatcacaaaccgttctgggttatcgatcaggtgaaagcggcggtggctgattgtctggctgctaccgataaacgcgtcagtgaactgaaaatcgcctgctttggtctggcgtttaaaccgaatattgatgacctgcgcgaaagtccggcaatggaaatcgctgaactgatcgcccagtggcacagcggcgaaacgctggttgttgagcctaacatccacgagttgccgaagaaactgaccgggctttgtactctggcgcagcttgacgaggcgctggcaacggcagatgtgctggtgatgctggtcgatcatagtcagttcaaagttatcaatggcgacaacgtccatcagcagtatgtcgtcgatgccaaaggagtctggcgctgatgagaaagattctgataacaggtggtgccgggtttattggctcggcgctggtgcgttatatcatcaacgaaacgagcgacgcggtggtggtggtcgataagctgacctacgccggaaacctgatgtcgctggcaccggtcgcgcaaagcgagcgctttgcctttgagaaagttgatatctgcgatcgggcagaactggcgcgcgtattcactgagtatcagccagactgtgtcatgcatctggcagccgaaagccatgttgaccgttctattgacggcccggcagcgtttattgaaaccaacattgtcgggacttatacactgcttgaagcggcgcgggcttactggactgcgctgacggaagataaaaaatcagcgttccgttttcatcatatctccaccgacgaagtatatggtgacctgcactcgacggatgatttcttcaccgaaaccacgccgtatgcgccgagtagcccttattccgcgtcaaaagccagcagcgaccatctggtgcgcgcctggctgcggacctatggtctgccgacgcttatcaccaactgctcgaataactacggtccttaccactttccggaaaaactgatcccgctgatgatcctcaacgcgctggcgggtaaaccgctgccggtatatggcaacgggcagcaaatccgtgactggctgtatgttgaagatcacgcccgcgcgctgtattgcgtggcgaccaccgggaaagtcggtgaaacctataatattggtggtcacaacgagcgtaagaatctcgatgttgtggaaaccatttgcgagctgctggaagaactggctccgaataagccgcacggcgtggcgcactatcgtgacctgatcacctttgtcgctgaccgtccggggcatgatctgcgttatgccattgatgcttcgaaaattgcccgtgaacttggctggctgccgcaggaaacctttgaaagtggaatgcgtaaaacggtgcagtggtatctggctaatgaaagctggtggaagcaggtgcaggacggcagctatcagggcgagcgtttaggtctgaaaggctaattttcagcggaggcaaacatgaaaggtattatcctggcgggcggttccggcacccgattgcatccgattacgcgcggcgtatcgaagcaactgttgccgatttacgataagccaatgatttactatccgctgtcggtgctgatgctagccggtatccgcgaaattctcatcattactacgccggaagataaaggttatttccagcgcctgctgggtgacggcagtgagttcggtatccagctggaatacgccgaacagcccagtccggacggtctggcgcaggcctttatcatcggtgaaaccttcctcaacggtgaaccttcttgtctggtgctgggcgataacatcttcttcggacagggcttcagtccgaagctgcgtcatgttgcggcgcgcacggaaggggcgacggtatttggctatcaggtgatggacccggaacgctttggcgtggtggagtttgacgacaatttccgcgctatctcgctggaagaaaaaccaaaacagccgaaatcaaactgggcggtgaccgggctttatttctacgacagtaaagtcgtggagtacgcaaagcaggtgaagccgtcggagcgtggtgaactggagattacctccatcaaccagatgtacctcgaggcgggcaacctgaccgttgaactgctcgggcgcggatttgcctggctggataccggcactcacgacagcctgattgaggccagcacttttgtgcagacagtagaaaaacgccagggctttaagattgcctgcctggaagagattgcctggcgtaacggctggctcgatgacgagggtgtgaagcgtgctgccagttcattagcgaaaactggctacggccaatatctgctggagttacttcgtgcccgtccgcgccagtattgagccactaacctgggaaaacgccttctttggtgttaacagcgccatcgtgcgcattacgtctgaagcaccgctcctgacgccagacgcgttagcgccgtggtcacgggtgcaggccaaaattgcggcatcaaatacgggtgaactggatgctctgcaacagctgggattctccctggtagaaggtgaagttgatttggcactacccgtgaacaatgtcagtgatagcggtgcagtagtggcacaagagaccgatattcccgcattacgtcagttagccagcgccgcatttgcgcaaagccgttttcgtgcgccgtggtatgcgcctgacgccagcggtcgcttttatgcacagtggattgaaaatgccgtgcgcggcacctttgatcatcaatgtctgattttacgtgcggcgtccggcgatattcgcggttatgtctctttacgggaactcaatgcgacagatgcgcgaattggcctgctggctggacgcggtgcaggtgctgagctaatgcaaacggcgctaaactgggcgtatgctcgcggtaaaacaactttgcgggtggcgactcagatgggcaacaccgccgcgcttaaacgatacatacaaagtggtgcgaatgtagaaagcaccgcgtactggttatacaggtgatcacatgattccatttaacgcaccgccggtggtgggaaccgaactcgactatatgcagtcggcaatgggtagcggcaaactgtgcggcgatggtggttttacccgtcgctgccagcagtggctggagcaacgttttggcagcgccaaagtgttactgacgccatcctgtaccgcttcgctggagatggcggcgctgctgctcgatatccagcctggcgatgaagtgatcatgccgagctatacctttgtctccaccgccaatgcctttgtgctgcgtggcgcgaaaatcgtctttgtggatgttcgcccggacaccatgaacatcgacgaaacgctgattgaagcggcgatcaccgacaaaacgcgcgttatcgtgccggtccattacgcgggtgtggcctgcgaaatggacaccattatggcgttggcgaagaagcataatctgtttgtggtggaagatgccgctcagggcgtgatgtccacttacaaagggcgtgcgctgggaaccattggtcatattggctgctttagcttccatgaaaccaaaaactacacggcgggtggtgaaggcggcgcgacgctgattaacgataaagcgttgatcgaacgagccgagatcatccgtgaaaaaggcacaaaccgcagccagttcttccgtggtcaggtcgataaatatacctggcgcgatattggctccagctatttgatgtccgatctgcaagctgcgtacctgtgggcgcaactggaagctgcggatcgtatcaaccagcaacgtctggcgctgtggcaaaactactacgatgcgctggcgcctctggcaaaaaatgggcgtatcgagctgccgtcgattcccgatggctgcgtgcagaacgcgcatatgttctacattaaactgcgggatattgatgaccggagcgcattgattaactttctgaaagaagcggaaatcatggcggtgttccattacattccgctgcacggttgccctgcgggggaacgctttggtgagttccacggtgaagatcgctacaccaccaaagagagcgagcgcctgctgcgcctgccgttgttctacaacctgtcgcccgtcaatcagcgtacggtaattgcgaccttgttgaactacttctcctgatatgtcgttggcaaaagcgtccttgtggacggcggccagtacactggtcaagattggtgccgggttactggtcggtaagttgctggcagtgtcatttggtccggcggggcttgggctggcggcaaatttccgccagttgattaccgtgctcggcgtgcttgccggggcaggcatctttaacggcgtaaccaaatacgttgcccagtatcatgataatccccaacagctgcgccgcgtggtcggcacttcatcagcgatggtacttggcttctctacgctaatggcgctggtttttgtgctggcagctgcgccaatcagccaggggttgtttggtaataccgactatcaggggctggtgcgtttagtggcgctggtgcaaatggggattgcctggggcaacctgttactggcgttgatgaaaggctttcgcgatgccgcaggtaatgcgttatctctgattgtcggtagcttgattggcgttctcgcgtactacgtcagttatcgtttgggcggttatgaaggggcgttgctgggtctggcgctgattcccgcgctggtggtaattcctgctgttatcatgttgatcaaacgtggtgtcatcccgttaagctatctgaaacccagctgggataacggtctggcagggcagttgagcaaatttacgctcatggcgttgattacgtcggtgaccttgcctgttgcttacatcatgatgcgtaaactgctggcggcgcagtatagctgggatgaagtggggatctggcaaggggtgagcagtatttccgatgcctacctgcaatttattacggcatcgttcagcgtatatttgctgcccacgttgtcgcggttaacggaaaagcgcgatatcacccgggaagtggttaaatcgctgaaattcgtcttaccggcagtggcggcggcgagttttaccgtctggttgctgcgtgattttgctatctggctgctgttgtcgaataaatttaccgctatgcgcgatctctttgcctggcagttggtgggtgatgtgttaaaagtgggcgcttatgtctttggttatctggtgatcgccaaagcgtcactgcggttttatattctggcggaaatcagccagttcactttattgatggtatttgcccactggctaatccctgcgcatggcgcactgggcgcagcacaggcctatatggcaacctatatcgtctatttttctctttgttgtggcgtgtttttactctggcgtaggcgggcatgactgtactgattcacgtactgggatcggatatccctcaccataaccgaaccgttctgcggtttttcaacgacgcgctggccgcgacgagcgggcacgcgcgcgagtttatggttgctggcaaggacgacggcttaagtgatagctgtccggcgctttctgtgcaatttttccctgggaaaaaatcgctggcggaagcggtcatcgcgaaagcaaaagctaaccgtcagcagcgattttttttccacggtcagttcaatcccaaactgtggctggctctgctgagtggtggcattaagcccagccagtttttctggcatatctggggagcagacctgtatgagctttccagtggcttgagatataagcttttttacccgctacgtcgcctggcgcaaaagagagtcggctgtgtatttgccacccgcggtgatttgagcttttttgccaaaacgcatccaaaggtgcggggagaactgctgtacttcccgacgcggatggacccttctcttaatacgatggcgaacgatcggcaacgtgaaggaaaaatgaccattctggtggggaactccggtgaccgcagcaatgagcatattgctgccttgcgcgccgttcatcagcaatttggcgatacggtaaaagtggtggtgccgatgggatatccgcctaataacgaagcgtacatcgaggaagttcgtcaggcgggactggagttattcagcgaagaaaacctacaagttctgagcgaaaaactggaatttgacgcctatctgacgctacttcgccagtgcgatctcggttactttatttttgcccgccagcagggcattggtacgctttgcttactgattcaggcgggcattccttgcgtgcttaaccgggaaaatccgttctggcaggatatgacggaacagcatttgccagtactgtttactaccgatgatctcaacgaggatattgtgcgtgaagcgcagcgccagttggcgtcggtggataaaaacaccattgccttctttagccctaactatctacaaggctggcagcgggcgttggcgattgccaccggggaggtcgcatgagtctgctgcaattcagtggcctgtttgttgtctggctgctctgcacgctgtttattgccacgctgacctggtttgagtttcgccgtgtgcgctttaacttcaatgtcttcttttcattgctgtttttgctcacctttttcttcggctttccgctgaccagcgtgctggtatttcgctttgatgttggtgtcgcgccgccagaaatcttgttgcaggcgttgctttctgcaggctgcttctacgcggtttactatgtcacctacaaaacccgtctacgcaaacgcgttgctgatgcaccgcgccgtccgctgtttaccatgaaccgcgtggagaccaatctcacgtgggtgatcctgatgggcatcgctctggtgagcgtcggcatcttcttcatgcacaacggctttttgctgttccggcttaattcttacagtcagatcttttccagcgaagtctccggcgtggcattaaaacgcttcttttactttttcatcccggcgatgctggtggtttattttctgcgccaggatagcaaagcgtggctgtttttcctcgtcagcacggttgcctttggcttgttgacttacatgattgtcggcggcactcgcgccaatatcatcatcgcattcgctatcttcctgtttattggcattattcgcggctggatttcgttgtggatgctggcggcggcgggcgtgctggggattgtgggcatgttctggctggcgctaaaacgctatggaatgaatgtgagcggcgatgaagcgttctatacgtttctctatctcactcgcgacaccttctcgccgtgggagaatctggcgttgctgttgcagaactacgacaacatcgacttccagggcctggctccaattgtccgcgatttctatgtctttatcccttcctggctgtggccgggtcgcccgagtatggtgctgaactccgccaactactttacctgggaagtactgaataaccactccggactggcgatctcgcctacgcttataggctcactggttgttatgggcggcgcgttgttcatcccgctcggggcgattgttgttggactgatcatcaaatggttcgactggctgtatgagctgggcaaccgcgagactaatcgctataaggctgcgatattgcacagtttctgcttcggggcgatcttcaatatgatcgtgctggcgcgtgaagggctggattcgtttgtctcacgcgtggtcttttttatcgtggtcttcggcgcatgtctgatgatcgcaaaactgttgtactggctttttgaaagcgccggactcattcataaacgaacaaaatcatcgctccggacgcaggttgaaggataacaatgaataacaacaccacggcaccgacctatacgctgcgtggcttacagttgattggttggcgtgatatgcagcatgccctcgattatctgttcgctgacgggcagcttaagcagggaacgctggttgccattaatgccgaaaaaatgctgaccattgaagataacgccgaggtcagggagttaattaacgctgccgaatttaaatatgcggatggcatcagcgttgtacgttcagtacgtaaaaagtacccgcaggcgcaggtttcccgcgttgctggggccgatctctgggaagagctgatggcgcgcgcaggcaaagaagggacaccggtatttcttgtgggcggtaaacctgaagtgctggcgcaaactgaagctaaactgcgcaaccagtggaatgtgaatatcgttggcagtcaggatggttattttaaacccgagcagcgtcaggcgctgtttgaacgcattcatgccagcggagcgcaaatcgtcaccgttgcgatgggatcgccaaagcaggagatcttcatgcgcgactgccgtctggtgcatccagatgcgctgtatatgggcgttggcgggacctacgatgttttcaccggtcacgtaaaacgcgcaccgaaaatctggcaaacgctggggctggagtggctctaccgcctgctttcgcagccgagccgcattaagcgtcagcttcgtttgctgcgttatttacgctggcattacaccggcaacctctgattttcctctctttgtaaagcgacggagtggtcacttcgtcgcctgtctgcttttttattacacaaagcattcaaatttttaatgctttatttgccatttctcctgaattacgaaaacattcgcaacactcgatgtacccataacgataaccggtaacaccggaaagcatgcaaacacaacacgaggatttatggcagataacaaaccagagctacagcgtgggctggaagctcgacatatcgaactcatcgccctggggggcaccattggcgtcggcctgtttatgggggccgccagtaccctgaaatgggccgggccatccgtattgttggcctatatcatcgccgggctgttcgtctttttcatcatgcgttcaatgggcgaaatgttgttcctcgaaccggttaccggttcgttcgccgtttacgcgcatcgttatatgagcccgttctttggttatctcaccgcctggtcttactggtttatgtggatggcggtggggatctcagaaatcaccgccattggcgtttatgtccagttctggttcccggagatggcgcagtggatacccgcattgatcgcggtggcgctggtggcgttggcgaatctggctgcggtgaggttgtacggcgaaatagagttctggttcgcgatgatcaaagtcaccacgattatcgtgatgattgtcattggcctgggcgtgattttctttggctttggcaatggcgggcagtcgattggttttagcaatctcacagagcatggcggtttctttgctggtggctggaaagggttcctgaccgcattgtgtattgtggtggcgtcctaccagggcgtggagctgattggcattactgccggtgaagcgaagaatccgcaggtgacgctgcgcagtgccgtaggcaaggtgctgtggcgaatcctgattttctacgttggcgcgattttcgttatcgttactatcttcccgtggaatgaaataggcagcaacggtagcccgttcgtactgactttcgccaaaatcggcattaccgcagcggcgggcattatcaactttgtggtgctgacggctgcgctctctggctgtaacagcggcatgtacagttgcggacgtatgctctatgcactggcgaaaaaccgtcagttaccggcggcaatggcgaaagtttcccgtcacggcgtaccggttgcgggtgtggcagtatctattgctattctgctaattggctcatgcctgaactacatcattcccaatccgcagcgtgtgtttgtttacgtctacagtgccagcgtgcttccggggatggtgccatggtttgtgatattgataagccagctgcgttttcgtcgtgcgcataaagcagcaattgccagccatccgttccgctcaatcctgttcccttgggccaactacgtaacaatggcattcctgatttgcgttttgatcggcatgtactttaatgaagatacgcgtatgtcgctgtttgtcggcatcatctttatgctgacggtgacggcgatttataaagtttttgggcttaatcgccacggtaaagcgcataaactggaggaataagcagcaaaacgcacaaaccgtaaccaaacgcgcaatttatttaaaaagggactagacagaggggtgggaagtccgtattatccacccccgcaacggcgctaagcgcccgtagctcagctggatagagcgctgccctccggaggcagaggtctcaggttcgaatcctgtcgggcgcgccatttagtcccggcgcttgagctgcggtggtagtaataccgcgtaacaagatttgtagtggtggctatagctcagttggtagagccctggattgtgattccagttgtcgtgggttcgaatcccattagccaccccattattagaagttgtgacaatgcgaaggtggcggaattggtagacgcgctagcttcaggtgttagtgtccttacggacgtgggggttcaagtcccccccctcgcaccacgactttaaagaattgaactaaaaattcaaaaagcagtatttcggcgagtagcgcagcttggtagcgcaactggtttgggaccagtgggtcggaggttcgaatcctctctcgccgaccaattttgaaccccgcttcggcggggttttttgttttctgtgcatttcgtcactttcccttcgcaataaacgcccgtaataacgcattgcgccacggtatgatttcgcccttaacttattgaaggatgacttcaggcaaggagcgaccatgcagcaacaggttccaacgcgtgcttttcatgtgatggcgaaaccgagcggttctgattgtaatctgaactgtgactactgtttttatctcgaaaaacaatccctttaccacgaaaagccagtcacgcatatggacgatgacacgctggaagcgtatgtccgtcactatatcgctgccagcgaaacccaaaacgaagtggcttttacctggcagggcggcgaaccaacgttactcgggctggatttttaccgccgtgccgtggcgctacaggcgaaatatggtgctggcaggaagataagtaatagcttccagactaacggcgtgctgctcgatgacgaatggtgtgcatttctggcagaaaatcattttcttgtagggttatcgctggatggtccggctgagatccacaatcaatatcgcgtgaccaaaggtggcagaccaacgcataagctggtgatgcgtgctctgacgctcctgcaaaaacatcatgtcgactataacgtgctggtctgcgtcaatcgcaccagtgcgttacaacctttgcaagtctatgattttctgtgtgatgcaggtgttgagttcatccagtttattccggtggtcgagcgcctggctgatgaaacggctgctcatgctggacttaagctacatgctcccggcgatattcagggcgaactgacggaatggtcggtgtgcccgcaagagttcggtgagtttctggtggcgattttcgaccactggattaagcgcgacgtcggcaagattttcgtaatgaatatcgaatgggcgttcgccaattttgtcggcgcaccgggcgcggtttgccatcatcagccaacctgtgggcgctcggtgattgttgagcacaacggtgacgtttatgcctacgatcactatgtttatccgcagtatcgactagggaatatgcttcagcagatgattgcagaaatgattgattccccgcaacagcaggcatttggtgaagataaattcaagcagttaccggcacagtgtcgcagttgcaacgtgttaaaagcgtgctggggaggctgcccgaaacaccgctttatgctcgatgccagcggcaaacccgggctgaattatttgtgtgccgggtatcagcgttatttccgccatctaccgccatatcttaaagcaatggttgatttgctggcgcacggtcgtccggccagcgacattatgcaggcgcatttgctggtggtgaataagtaaaaaagcagccattttgtggccgcctgcggttgattgtcggatgcgtcagcatcgcatccggcaaaggtagatctcagcgatagcgccggcttaatcagatttaatctgcgcgcgtggtggatattttttcaggatctccatatacgcatgcatttcggtctgtagcggtacacccattgggatatggcgcacgccgatagagtcgctttcctgcggatcggtgtacaggttaaacaccgacgatcccgccgtttgcattactgtgccggtgaatccaccctgatatccgctctgggtataagcgtaaggttgctgaatcaggacgtgatacttgaactcatccatacgcacagcagaaagtttaccgttgaggaagtaatgctcggccttacggttagactgaccatttgttcccaggaagaaagatgtctggtccacaccatcgataaaggtggttttcggtactaaattcgctactttcgccccaggatgccccgccagatccagcgccgtagggaagagatccgccagatcgacaatgccgtcagatttacgcggttggatcatgcctttccagtaaacgaaggttggcacacgaacgccgccttcccatgtagaacctttcgcaccgcggaacggcgtgcgaccgtgcggcggaacttcggcttccggaccgttatcagaggtgaacacaatcagcgtgttatcaagctgaccgtttttctccagtgctttatacagattggcgaagatatcgttcatctccaccatgcagtcgccgtaagaggtgcgcgccggagagctacccgcatatttggcgttcgggtagttatcgaagtgacagccgcgagtgccgtaatagaggaagaaaggcttatcactcttcgccatcttgtcgaggaacttaacgccatattccatccagtgttgatccaggtcttccatatatttcggcgtaatgtcggcaatggcttcctgttcaccaccgtgcacggcatgaacgtcatctttgctgaacggcagtttttggatgtattcagaacgagccgggctcagggcgacttccgggttgacatgaacatcacgccattcggtatacatatcggacaccgagttaaagccgcggaaatcatcaaagccaacgttctgcggctgcgactctttgttttcccccatatgccatttcccgatagcctgggtgatgtagccctgatcgtgcagcaactgcggcagcgtggttaacccttgcagaccgcccggttgcccgtacattggcggcatcagaatgccgtggtggatggagtattgtccggtgagaatcgtggcgcgggttggggaagaactcggttgagaatacgccgaagttaaaatcagcccctggctggcaacggcgtcgatatctggtgtagggttacccaccgccacgccgccgccgttaaagccaacgtccatccagcccacatcatccagcaagaaaacaaccacgttcggtttcttaccggtttttttctcaagttccgccagtttctgctgggtttctttgtcttgtgcaggatgctgcatcaccggcatcatgttgtcggcaatagtggtcgccggtttaaccagatactggtttgggtgatcgtatccggcaaagcctttgcgtgcggtggcggttgacggggtatctgctgcgctggctatgagaggaagagctgcggcgacagcaacaacaagaagtttgggtgaaaacgaaaattccatgcaaaatgctccggtttcatgtcgtcaaaatgatgacgtaattaagcattgataattgagatccctctccctgacaggatgattgcataaataatagtgataaaaataaattatttatttatccagaaaatgaattgaaaaatcaggagagcattttcaatcctacctctggcgcaggtgatatgtaaggcggtgatgttatatcgcgttgattattgatgctgtttttagttttaacggcaattaatatatatgttattaattgaatgacttttattattcattatatatatgtgtagaattgtgcgcaggagaaatattcactcaggaagttattactcaggaagcaaagaggattacagaattatctcataacaagtgttaagggatgttatttcccggttctctgtggcataataaacgagtagatgctcattccatctcttatgttcgccttagtgcctcataaactccggaatgacgcagagccgtttacggtgcttatcgtccactgacagatgtcgcttctgcctcatcagacaccatggacacaacgttgagtgaagcacccacttgttgtcatacagacctgttttaacgcctgctccgtaataagagcaggcgtttttttatatatcagaaaggccccggaggtgcttgcctccgggtgagaaagagctactgtggcgggttgttctgcaacgttaacatcaaaccgtcgcgacgcatcgctgcggcttcttccggcttgtgcagtctgtccagcgcgtcggcaagccatgcgtaatcgtaggcgtccggacgttgtttcagcgctgcgcggaaggcgagcgatgcttcctgccattctccgtgtttcatcagcgactgacccagtgtgctccacaacagcgggcgatcgcccacgtttttgatctgttggcgcagcactttttccagctgttccgggttattggttttcagacgcgggatcggcagcagcaggcgatcgtcatactggcgtttcaggccgtcgatgataatttgctgggcagtatcatgatcgtcacactcaataagatgttccgccattgccacctgcaaggccacctgatgacgcgttttccggctttggtttttccaccagttacgcaaaccttcactaccgttatcggcacgcgcctgatccatcaggccaatccatgcctgttgttccagcattgcacgatgttcttcatcaccaacatgggctttcgccattgatgggatgatatccagcagcgaactccatgcaccagtgcggatatacgcctgttccgccagacgtaatacttccggatggcgtggcgtaacttccagcagcttatccacgccgtgacgtgctgcatggttttcattacgggccagttgcagacgtacacgggtgatttctaccggaatggtgtcattgccggccagctccgctgcgcgttccagatgttggttggcgcgtgcttcatcaccacgttgttgcgcggcttcggctgccagtagatagttcaccaccggttgttcagcgtgatcggcatttttcgccatcagcttttcaacttgctgataatcgccttccgccagtttcagcagcgcctgttcggtctgcttacgtgcacggcgacgcttacgtccgacaaaccacccacgggtgtgcgcgcctgtgcggaagattcgccgcagtagccactcaatggcaaacagcactaccatcgccagaatcaaaataatcgcgaggcccgtgacgctagtttcaatattgtagttgtcggtctggatcagcacgtaaccctgatggccggcaatcatcgggccaaccacgatccccgcaatcagcaacacaaagagcaataacacttttagcatggttattctccttgcggcgcggctgccggagcatcagcttgcggtgcaggtgcaggtgcaggtgcaggtgcaggtgcaggtgcaggtgcaggtttagcttccgttgtccccgctgccggttgtgccagcaggttacgcacgcgagtctgcatcagtttttccagcatcgcctggctttgcagggtttccgggagatccatcgagatattttgctggcttaactggtccacctcgtcgaggaacgctttggtggtggcatcatcagtatcgtagtaagcacgtacccaggtggagacgttctccagcgcctggcgataagtctcttcctggtgacgcggtacagcttgtgctgcgaccagcaggcgagagcgaatattttcgcgcagatagatatcctgatttggcgctaacagcggtacggcggtgtcatcacgacggcgaatcgtaatgaagttgtccataaagttctgccagcttttttgcagattgatacgccattcgctgatggaactggaaagctcttcaccgtcggaatccatcggcgaaccatcgctgtcattatcggccagacgcagattatctacctgatttgaaagctgattaagcttaaggatgataccgtcataatccacctgcgataccgcagaaaggctggcgatatcatcggtaattgcccggcgaacggtaatcagactcgggtcattcatatccgccaggctggcgtctgcacttttcagcaacgctgcagcggtcgtgacgtcctgatcgctccacagcttccgtccggcgagtttcaccagaaaatcggcctgggccagcagccaggttttagcatcgctgccggaaatggtggcgaccttttgttggacttcatccagctgttttgccagcgtttcttgctgacgattcgcctgctcaagctgtacagcttgttgcttgataatgccttccagctcggctttttggctctcctgggctttttgcagtgccgtaagttggttagccagggcatcgctggtggcagtctgattgacggcctgttgtttaccccagccatacaaaccgacgcccgccgccagagcaatagcgatagccaccgcgctgagaatcaatgcggtattgttcttactctttttttctgttgcgacaggttgtgacgtggtgtccacggcctccctggtctcttcaaccacggcggaggttttttcttgttccgtcattatggcttcctgttatgagagttattgtaatgcccgtaaaagcgcatcgttatcagcgttatcggcgaccttaatgtcttgccagcccagttcccgggcgagtttcgccaaacgctcactgacgactaatagtcgacagcgtagtaaccagtgctcacgataccattgtgggatcagcgaccagagttgctgcaacatttcaccgctggtaacaacgaccgtcgtcacctcgcgggattgccagcgcatcgcttcttctgcaccatcgtaatggattgcgcatcgttgataacattcacaaaaagtgacctcagcaccgcgcgccgtcagggaatccctaattagctcacgaccgccattgccacgtaatatcagcgcacgtttgcccgcaatattttgtaattcaggtaattgtagcaagacttcgctgatttcccgatcctgcgggtagagaatcttctgtccgcttacggtatgtagtgccagcgcggtggtgcgtccaatggcgaaataatcaggtagtcggggccatttacgatcttgctgatgcagctgtgattgggcaaaagcaaccgcgtgttgcgagagggcaaacaacagatcgctctctcccagcgctgccagttgatcagcaagttgcggtaattgtcgacccggagaaaactcaatcagcggaaaatgccaggccacctgccccagtgtgcgcagacggctcactaactcttctcctgcgggagacgggcgggtgaccaggatactcatgccggggcgtctccgttatagacttcagcgaggatctcgcgcgcgccgttattcagtagctcttctgccagcgaaatccccatttgttcggcatcttgcggcgcaccgcggcgttcaccgcgaataatctgcgaaccgtccggcgcgccaaccaacgcacgcagccagatttcgccatcaataagctcggcgtagctaccaattggcacctgacatcctccttcgagacgggtattcatggcgcgttcggcggtaacgcgcagtgcagtttcgtggtgattcagcgcggcgagcagctcgcgagtgcgtgcatcatcaaggcggcattcaatgcccaccgcaccttgccctaccgccggaagagaaatctcgggtggcaacgcggcgcgaatgcgggactccagacctaaacgttttagtccggctacggcaagaatgatggcatcatattcgccgttatccagtttgctcagacgagtgccgacgttgccgcgcagggagcggataatcagatccgggcggcgttcagccagttggcactggcgacgtaaactggacgtcccgacgatactgcctgccggtaacgcatccagactgtcataggtgttggatacaaaggcatcgcggggatcttcgcgcttgcaaatggtgaccagccccagaccttgcgggaattcaaccggcacatctttcattgaatgtacggcgatatcggcgcgattttcgaggagcgcgacttccagctctttcacaaataagccttttccgcctactttcgccagcggcgtatcaagaatcacatcgccgcgcgtcaccatcggtaccagttcaacgaccaggcccggatggctcgccatcaacttgtctttgacatagtgtgcctgccagagtgcaagtgggctttggcgtgtggcaattcttaaaacattgtctaacatgcttgttaccgtcattatcatccgtggtccatcctaacatccttgccagagcgatgtcagtgttgtggtgaaacgtagacgcctgcgcaaaccgtaaaatgaggtctggcagtggatcctgacaggcgctttgagccttcgtaataaggaatttacagagaataaacggtgctacacttgtatgtagcgcatctttctttacggtcaatcagcaaggtgttaaattgatcacgttttagaccattttttcgtcgtgaaactaaaaaaaccaggcgcgaaaagtggtaacggttacctttgacatacgaaatatcccgaatgccgcgtgttaccgttgatgttggcggaatcacagtcatgacgggtagcaaatcaggcgatacgtcttgtacctctatattgagactctgaaacagagactggatgccataaatcaattgcgtgtggatcgcgcgcttgctgctatggggcctgcattccaacaggtctacagtctactgccgacattgttgcactatcaccatccgctaatgccgggttaccttgatggtaacgttcccaaaggcatttgcctttacacgcctgatgaaactcaacgccactacctgaacgagcttgaactgtatcgtggaatgtcagtacaggacccaccgaaaggtgagcttccaattactggtgtatacaccatgggcagcacctcgtccgtagggcaaagttgttcctctgacctggatatctgggtctgtcatcaatcctggctcgatagcgaagagcgccagttgctacaacgtaaatgtagtctgctggaaagctgggccgcctcgctgggtgtggaagtcagcttcttcctgattgatgaaaaccgcttccgtcataatgaaagcggcagcctggggggcgaagattgtggctccacccagcatatactgctgcttgacgaattttatcgtaccgccgtgcgtctcgccggtaagcgtattctgtggaatatggtgccgtgcgacgaagaagagcattacgacgactatgtgatgacgctttacgcgcagggcgtgttgacgccaaatgaatggctggatcttggtggcttaagctcgctttctgctgaagagtactttggtgccagcctttggcagctctacaagagtatcgattccccatacaaagcggtgctgaaaacactgctgctggaagcctattcctgggaatacccgaacccacgtctgctggcgaaagatatcaaacagcgtttgcacgacggcgaaatagtgtcgtttggtctcgacccctattgcatgatgctggagcgcgtcactgaatatctgacggcgatcgaagattttactcgtctggatttagttcgccgatgcttctatttaaaagtttgcgaaaaactcagccgtgaacgcgcctgcgtaggctggcgtcgtgaagtgttaagccagttggtgaaagagtgggaatgggacgattctcgtctggcaatgcttgataaccgcgctaactggaagatagatcaggtgcgtgaggcgcacaacgagttgctcgacgcgatgatgcagagctaccgcaatctgatccgctttgcgcgtcgcaataaccttagcgtttccgccagcccgcaggatatcggtgttctgacacgtaaactgtacgccgcgtttgaagcgttaccgggtaaagtgacgctggtaaacccgcagatttcacccgatctctcggaaccgaatctgacctttatttatgtaccgccgggccgcgccaaccgttcaggttggtatctgtataaccgcgcgccaaatattgagtcaatcatcagccatcagccgctggaatataatcgctacctgaataaactagtggcgtgggcatggtttaacggcctgctgacctcgcgcacccgcttgtatattaaaggtaacggcattgtcgatttgcctaagttgcaggagatggtcgccgacgtgtcgcaccatttcccgctgcgcttacctgcaccgacaccgaaggcgctctacagcccgtgtgagatccgccatctggcgattatcgttaacctggaatatgacccgacagctgcgttccgcaatcaggtggtgcattttgatttccgtaagctggatgtcttcagctttggcgagaatcaaaattgcctggtaggtagcgttgacctgctgtatcgcaactcgtggaacgaagtgcgtacgctgcacttcaacggcgagcaatcgatgatcgaagccctgaaaactattctcggcaaaatgcatcaggacgccgcgccgccagatagcgtggaagtcttctgttatagccagcatctgcgcggcttaatccgtactcgcgtgcagcaactggtttctgagtgtattgaactgcgtctttccagcacccgccaggaaaccgggcgcttcaaggcgctgcgcgtctccggtcaaacctggggcttgttcttcgaacggctgaatgtctcggtacagaaactggaaaacgccatcgagttttatggcgctatttcgcataacaaactgcacggcctgtcagtgcaggttgaaaccaatcacgtcaaattaccggcggtggtggacggctttgccagcgaagggatcatccagtttttcttcgaagaaacgcaagacgagaatggctttaatatctacattctcgacgaaagcaaccgggttgaggtgtatcaccactgcgaaggcagcaaagaggaactggtgcgtgacgtcagtcgcttctactcgtcttcgcacgaccgtttcacctacggctcaagcttcatcaacttcaacctgccgcagttctatcagattgtgaaggttgatggtcgtgaacaggtgattccgtttcgcaccaaatctatcggtaacatgccacctgccaatcaggagcatgacgcgccgctgttgcagcagtatttttcgtgatgaacgtgccggaaagcgaggcttatccggcatgcaatcttagcggaaactaactgtttcacccgcctgctgcgtcgccgcctgttccagcaaatcccagaaggtttcaccgctacgatcgcaaatccactcgtcgcctttcagatcaaaatggtagccaccctgtttggttgctagccacacctggtgcagtggttcctggcggttgataatgattttgctgccgttctcaaaggtaatggttagtacaccgccgttgatttcacagtcgatatcgctgtcgccatcccagtcgtccagatgttcttcaatggtcagccacagttgatcagccaggcgatgaaattcactgtcgttcattgttgtatcctgtttttaagtgatggcggcagtatagcggcatggggtcagggcttcaaagtttgcccgtctgctgctgcgttccggcatgattcatccgtcaccggaataataatatctctatatagcgaaagattggtcttttcataagggcgcaaatacaccacgccttttccctatttctggtaaatattatgttccggctcatcaagccgacatccccatgccgacgataaaaacaacgaacaagacaacaaacaaaccacattgtgatagtgcataaagccatcctggcgcgaggtgccgatcacgaaactaccagcaaaacataaatcgccacgagtaagcgttatactcgcagcatttcctcacttttcagacttcataaagagtcgctaaacgcttgcttttacgccttctcctgcgatgatagaaagcagaaagcgatgaactttacaggcaatccataatgaaaaacgtgtttaaggcactcactgtattacttactctcttcagcctgacgggctgcggtctgaaaggtccgctctatttcccgcctgcagataaaaacgcaccgccgccgaccaaaccggtagagacgcaaacgcaatccacggtgccggataaaaacgaccgcgccactggcgatggtccatcccaggtgaattactaaaagtcagtttctgtacccgcgtgattggagtaaatgatgcagttctcgaaaatgcatggccttggcaacgattttatggtcgtcgacgcggtaacgcagaatgtctttttttcaccggagctgattcgtcgcctggctgatcggcacctgggggtagggtttgaccaactgctggtggttgagccgccgtatgatcctgaactggattttcactatcgcattttcaatactgatggcagtgaagtggcgcagtgcggcaacggagcacgctgctttgcccgttttgtgcgtctgaaagggctgaccaataagcgcgatatccgcgtcagcaccgccaacgggcggatggttcttaccgtcaccgatgatgatctggttcgcgtaaacatgggcgagcccaacttcgaaccttccgctgtgccgtttcgcgctaacaaagtggaaaagacctatattatgcgcgccgccgagcagacaatcttatgtggcgtggtgtcgatgggaaatccgcactgcgtgattcaggtcgatgatgtcgataccgcggcggtagaaacgcttggtcctgttctggaaagccacgagcgttttccggagcgcgccaatatcggttttatgcaagtggttaagcgcgagcatattcgtttacgcgtttatgagcgtggggcaggagaaacccaggcctgcggcagcggcgcatgtgcggcggtggcggtagggattcagcaaggtttgctggccgaagaagtacgcgtggaactccccggcggtcgtcttgatatcgcctggaaaggtccgggtcacccgttatatatgactggcccggcggtacatgtctacgacggatttattcatctatgaagcaaccaggggaagaactgcaggaaacactcacggagcttgatgaccgggcggttgtcgattatctgattaaaaatcctgagttttttatccgcaatgcgcgcgcagtagaagcgatacgtgtgccgcatccggtacgcggcaccgtttcgttggtcgagtggcacatggcccgcgcacgtaatcatattcatgttctggaagagaacatggcgctgttgatggaacaggcaatcgccaacgaaggcctgttttatcgtctgctctacctgcagcgcagtctcaccgccgccagcagtctcgatgatatgctgatgcgctttcaccgctgggcgcgcgatctcggcctggcaggtgcgagtctgcgcctgtttccggatcgctggcgcttaggtgcgccgtcgaactacactcatctggcattaagccgtcagtctttcgaaccgctgcgtattcagcgtctggggcaggaacagcactatctgggaccgcttaacggaccggagctgctggtggtgctaccggaagcgaaagcggtgggatcggtggcgatgtcgatgctgggaagcgatgctgatttgggtgttgtgctgtttaccagtcgcgatgccagtcactatcaacaagggcagggaacgcagttacttcatgaaattgcactgatgttgccggagcttctggcgcgttggattgaacgcgtatgaccgatttacacaccgatgtagaacgctacctacgttatctgagcgtggagcgccagcttagcccgataaccctgcttaactaccagcgacagcttgaggcgatcatcaattttgccagcgaaaatggcctgcaaagctggcagcaatgtgatgtgacgatggtgcgtaattttgctgtacgcagtcgccgtaaagggctgggagctgcaagtctggcgttacggctttctgcgctacgtagcttttttgactggctggtcagccagaacgaactcaaagccaacccggcgaaaggtgtttcggcaccgaaagcgccgcgtcatctgccgaaaaacatcgacgtcgatgatatgaatcggctgctggatattgatatcaacgatcccctcgctgtacgcgaccgtgcaatgctggaagtgatgtacggcgcgggtctgcgtctttccgagctggtggggctggatatcaaacacctcgacctggagtctggtgaagtgtgggtgatgggaaaaggcagcaaagagcgccgcctgccgattggtcgcaacgctgtggcgtggattgagcactggcttgatttgcgcgacctgtttggtagcgaagacgacgcgctttttctgtcgaaactgggcaagcgtatctccgcgcgtaatgtgcagaaacgctttgccgaatggggcataaaacaagggctgaataatcacgttcacccgcataaattacgtcactcgttcgctacccatatgctggagtcgagcggcgatcttcgtggtgtgcaggagctgctgggtcatgccaacctctccaccacgcaaatctatactcatcttgattttcaacaccttgcctcggtgtacgatgcggcgcatccacgcgccaaacgggggaaataatgcgtttttaccggcctttggggcgcatctcggcgctcacctttgacctggatgacaccctttacgataaccgtccggtgattttgcgcaccgagcaggaggcgcttacctttgtgcaaaattatcatccggcgctgcgcagcttccagaatgaagatctgcaacgcctgcgccaggcggtacgggaagcggaacccgagatttatcacgacgtgacgcgctggcgttttcgttcgattgaacaagcgatgctcgacgccgggctgagtgccgaagaagccagtgcaggcgcacacgcggcaatgatcaactttgccaaatggcgcagccggatcgacgtcccgcagcaaacccacgacaccttaaaacagctggcgaagaaatggccgctggtggcgatcaccaacggtaacgcccagccggaactgtttggtttggggcattattttgagtttgtgctgcgcgctggcccgcacgggcgctcaaaaccgttcagcgacatgtacttactggcggcggaaaaacttaacgtgccgatcggtgagatcttacatgtcggggacgatctcaccactgacgtgggtggggcaattcgcagcggaatgcaggcctgttggatcagaccggaaaatggcgatctgatgcaaacctgggacagccgtttactgccgcatctggaaatttcccggttggcatctctgacctcgctgatataatcagcaaatctgtatatatacccagctttttggcggagggcgttgcgcttctccgcccaacctatttttacgcggcggtgccaatggacgtttcttacctgctcgacagccttaatgacaaacagcgcgaagcggtggccgcgccacgcagcaaccttctggtgctggcgggcgcgggcagtggtaagacgcgcgtactggtgcatcgtatcgcctggttgatgagcgtggaaaactgctcgccgtattcgattatggcggtgacgtttaccaacaaagcggcggcggagatgcgtcatcgtatcgggcaactgatgggcactagccagggcggtatgtgggtcggcaccttccacgggctggcgcaccgcctgctgcgtgcgcaccatatggacgccaacctgccgcaggatttccagatcctcgacactgaagaccagctacgtctgcttaagcgtttgatcaaggcgatgaatctcgacgagaagcagtggccgccgcgtcaggcaatgtggtacatcaacagccagaaagatgaggggctgcgtccgcatcatattcagagctacggcaacccagtggagcaaacctggcagaaggtgtatcaggcgtatcaggaagcctgtgaccgcgcgggtctggttgattttgctgaattgctgcttcgtgcccacgaattatggctcaacaaaccgcatatccttcaacattaccgcgaacgtttcaccaatatcctggtggatgaattccaggacactaacaacattcagtacgcgtggatccgactgctggcaggcgatactggcaaagtgatgatcgttggcgatgacgaccagtcaatctacggctggcgcggggcgcaggtcgagaatattcagcgtttcctcaatgatttccccggtgctgaaactatccgtctggagcagaactaccgctctaccagcaatattctgagcgccgctaacgccctgattgaaaacaataacgggcgtctgggtaaaaaactgtggaccgatggcgcggacggtgagcctatttccctctattgcgcttttaacgaactcgacgaagcgcgttttgtggttaaccgcatcaaaacctggcaggacaacggcggggcgcttgccgagtgcgccattctctaccgcagcaacgcccagtcgcgtgtgctggaagaggcgttattgcaggcgagtatgccgtatcgtatttacggcgggatgcgcttcttcgaacgccaggaaatcaaagatgcgctctcgtatctgcgcctgattgccaaccgcaacgacgacgcggcctttgagcgtgtggtgaatacgccaacgcggggtattggtgaccggacgttggacgtggtacgtcagacatcgcgcgatcgccagttaacactctggcaggcatgtcgtgaactgttgcaggaaaaagccctcgccggacgtgctgccagcgccttacagcggtttatggagctgatcgacgccttagcgcaggaaactgccgatatgccgctgcatgtacagactgaccgggtaattaaagactccggcctgcgcaccatgtacgagcaggagaagggcgaaaaaggtcagacgcgtatcgaaaacttagaggaactggtgacggcaacgcgccagttcagctacaacgaagaagacgaagatttaatgccgctgcaggcattcctctcccatgcggcgctggaagcgggcgaggggcaggcggatacctggcaggatgcggtgcagttgatgacgctacactcggcgaaaggtctggaattcccgcaggtgtttatcgttggtatggaagagggcatgttcccaagccagatgtcgctggatgaaggcgggcgtctggaagaagaacgccgtctggcctacgttggcgtaacccgcgcgatgcagaaactgacgctgacctacgcggaaacccgccgtctgtatggcaaagaggtttaccatcgcccgtcgcgctttatcggtgagttgccggaagagtgtgtggaagaggtgcgcctgcgcgccacggtaagccgcccggtcagccatcagcgtatgggtacgccgatggtcgagaacgacagcggctataagctcggccagcgcgtacgccacgctaagtttggtgaaggcaccatcgtcaatatggaaggcagcggcgagcatagccgtttgcaggtggcattccagggccagggtattaaatggctggtggcggcttacgcccgactggagacggtataatttacgattccgttgccagatacggtgcgccacaccgcatccggcatcagtaacttacttagtgcacttcttcacatcaatattccagtcagcaccagacgcaacctgatgtttctgcgcgaaattatccatattcagcgccacggaaacattcaataagctgttcagatacaccatcggctggccttccggcacatcgccgaagcttgcgacatacggcattttccctgcgtatttttgctgggaaccttcggaaatggtcacacacaacgtgtcgttgagtttgattcctgcctgattcagcaactcgtcgctgatattgctccagacgttgccgtactgaatatcgagaatcgggatattgcccttcacttcaccttttgttgctttggctttctgataagaaagttcgacaacttttgcaggaagctctggccccacctgctcgaacgtgatcgccccggaagccagacgtgcaccggtgtaggcatacacatcacgaccgtggaaggtatatgacttttcggaacctttcagacggttggttttttcatcgatttgccggacgctctcaatacccagcgattccgccaccaacgtgagcgtaccgttatctggtgaaacgaagtactgaccgtttttggttttcagcactaccgatttacggtctgtaccaacaccaggatcgaccacgctaacaaacaccgaaccttgcggccagtaactggcagtctgatacaggcggtaagcgccttcccagatgttatacggtggaatttcgtgtgttaaatcaaatattttaagattatggtcaacgccgaaagcgacccctttcatcgccgagacggcgccatctttcaggctaaaatccgtttgtaaaatcaaagcgttatccgcataagcggatgatgaccccagacaggttaataaaaataatgttgcgagcgtttttttcatttttgtttcccttcatttatctgatgattttccagctgtgtagccagccccagtttgtctggcctcctcgagtgtacaatgtttaacctttctgctcgacggaaatcatggtgacaaaaggatagcgttgccacgggattgcctcgcctttcatatacatatgtgaaattgtgccatcaagataaagcagctgcccaacgttcagtttcgctttggcataacaggcaaaatcataaaaatttgtcgcctgctggctcaacaaaaacacggcgttcccatgtttattaatcccaacaccgttacgaattttacgtgaggcgacgttgggatgaatacgcggattaattacaccgttttccatcaacaatggccctgactgcaccgcaaactgaatctctttactggttttaaaggcatccagacgaacgatgccgactttatctcccgcgacataaaacactccgccaggacgaataaagaaattcccttcacctgaagcgagatttaacgccaccttctgctgaccgttttcgatgtacaaaccgagcggcgcatagctttcatcatagatgccgccgttcatcgccatctgcacctgaccctgactattaatatccgccagcagagcatgtaacgttccccacgcttcgccattggctttttgccagtacattttcacccgctctgtttgaggattaacggtatacgcctgtacggtcagcgtcggatctgagggtgcgcaatcatcagcggcaacagcaaacaagggaagtaaggtgagggtgagaaaaatccgtttgagattcaaggtgatcattcctttaccaatgaatagccgatgcgccattataggccctgaatgtgggatttttttatcctgttagcgaccttgacgagtaccaaaaagcgcgaagttcaactattgttctgtggtgttctgttgcgtgttgacggcaaaattttgctggcgtaacatgcgcgcacgatcactctaagaggacattcgccttggacacacccagtagatactggctcattatcctgtcatccaggatcaactcctaaggctatccctttttgctgatagccttagcggttgtcagcgacctcaatttttcccgtcgcgctgagtcaggctgtttaatggtctgaaacccaatttgtttctgtgtgcccaccgaactgtccgatattttaagcattgggagtcccggtcatgctgagcgcatttcaactggaaaataaccgactgacccggctggaagtcgaagagtcacaaccccttgtaaatgcagtatggattgatcttgtcgaaccggacgacgacgagcgactgcgcgtacaatctgaacttggccagagcctggcaacccgcccggaactggaagacatcgaagcatcggcacgtttctttgaagacgatgacggcctgcatattcactccttcttcttctttgaagatgcggaagatcacgccggtaactccactgtggcatttaccatccgtgatggtcgtctgtttactctgcgtgagcgtgaactgcccgcttttcgtctgtatcgtatgcgtgcccgtagccagtcaatggtggacggtaacgcctacgagctgctgctggatctgttcgaaaccaaaatcgaacagttggcagatgaaattgaaaatatctacagcgacctggagcagttgagccgggtaattatggaagggcatcagggcgatgagtacgacgaggcgctctccacgctggcggaactggaagatatcggctggaaagttcgcctgtgtctgatggatacccagcgcgcgctcaacttcctggtacgtaaagcacgcttaccgggtggacaactggagcaggcgcgtgaaatcctgcgagatatcgaatccctgctgccgcataacgaatccctgttccagaaggtgaacttcctgatgcaggcggcgatgggctttatcaatatcgagcagaaccgcatcatcaaaatcttctcggtggtatccgtggtgttcctgccaccgacgctggtcgcttccagctacgggatgaactttgagtttatgccggaactgaagtggagcttcggctacccaggcgcgattatctttatgatcctcgcgggcctggcaccgtatctgtactttaagcggaagaactggttgtaatataaatgccgggtaaagattgttctttatccggcttattgctgaaaattgtctttttcaaagtcatgcgggttgaacactcgctctatcttattttcctgggttagttgatactcattgttatcagcaataaaaaaatgagtattacggtaaggatattcattaataaccattaaatagttttttacgatgcaattatcattgctcttaatcgtcgggaaacagtagagatcttcatacggcccttcgatatattttttatagtcagtgaagccattaccgatatcaataacataccaggtatgccaactatcttctggtaggggattttgacttttaatttcatcctgatgcttcagataccaatttattttatcgctatcagtccatggcagatgatcaacgaccagaaagactgaattgccagcatcagagtatgtatacaaaatctgtacaggacgcaatgtccataaattatagatgcagcatagaagaaataaatataatataattttctggagttttcttttcatagataattttcgattctttcgatagtgttaaaattggtgaaaaaaggtttgaaagcaaagtctttatgccgttgtaaaaagaaccatatgcgaaaaaatctatacttgttgtaaatcttgttttttatatcagtcacatccaaactaaagtggtcttgtgctatgaaatgaatggtagcgctccagcccataggatatttttgaaaatttaaaagagatattttttgagctgagatatcatgaatgctgattcccaggccattaaaattatctttaaaatcattgaatttatttagtcttgatgaaagtaattcggtcttaatcttttgtaggagaagaggccggtatcctatcgtaggtgttgaagaaatatcattttcgatacattctttgattacacgtattgggctattataatcatatttgtttattcgttcatgaaaagataagttcaattcctggctatggaaactgttgccatttccatatctaaaatgatcaatcagatcctggatgagtgttttgtattgtccaaaaaaggaaaacatttttgccagatctttcatttctgcaaataaaatatcaatacattcactttgtgatatttttgttccagaagttggaacactaaaagcaccataagtagaattcggcccaggaaaatggtatttaatgaggcggtaaggatcaacttttgcagagatgtcgcttaagccgagagagagaaaatcttgttcttccatatccccatactgcatatcatcagcagaaaaatcatcgaataaagtaatagtttcgaaaagtgtacagggcatattaattgatgagcctaatatgttgttcatttatattctcctttcttataattaagggcaatgttaatttgataagaaataatagggtaaaaaattttaaaaaagaaatgcacttcacattttttattacattctgaagagaacttggttaatgattggtcttgctcatcgctaataacataatgctgaatttaccaaaaatgaaatttattaaagcaaatgaaaatatacaacgacgtctggaaattctgcctttccttatgtgagtctcctgtcagcatggcaatatgcccactctcatgcaagagtcggcatattttttcagaatatatttattttttatttggacgttctacgctgcgtataaatcgcatccatcacaaaaattgccagcgccacccaaataaaggcgaaagttaccatcttatcggcacccggtttttcaccataaaacgtcacagccagcaggaacatcagcgtcggaccaatgtactggaaaaagcctaacgttgagagacgcaggcgtgtcgccgctgcagtaaaacacaacagtggcacggtggtgacaataccggcggcgatcagcagtaaattcagcgacatcgggttttgccccatatgactggttgagctgtcggcaatagcaaacaggtaaatcgccgccacgggcagcaaccacatagtttcgattaacatgccggtttgcgcttcaacagcaatcttcttgcgcaccaggccgtagaaagcaaaactaaacgccagccccagcgcgatgatcggcagtgaaccaaaagtccacaactgaaccagcactccacatatcgccagaatcaccgccagccattgcattcggcggaatcgctcgccgaggaaaatcatccccagcacaatgttcaccagcgggttaataaagtaaccaaggctcgcttccagcatatggtgattgttcaccgcccagataaacagtagccagttgccgccaatcagcacggcagagactgccagcataaaaattttctgtggcgtctgaatcagcgtttttaaataggaccactggcggcaaatgctcatcagcaccaccataaagaaaaacgaccagatcacgcgatgcgtcaggatctcatcggcgggcacgtagtaaatcagtttgaagtacgctggcgcaataccccaaataaaataagcggcaagagcgagtaatacgccctgccgcgtttgttttgcatccatcgggaatactcatttttaattggtaacagcagtttacctgcttttatgtcttcaacctaccatataggtggcggtggcactggcaatataaagctgttcttcattgtgtaattcaacgcgggcgacggcgactttattgcctgcacgtaacaggctactggtagcagtaaaacgctcgcctctgcctgggcgcagataatcgacgcgaagatcaatggtccccatccgcgatagccgctggcgtagttcatcttcactgatggtttcgtggcgggttaaggtacttcccacgcacaccagacctgcggcgacatccagcgccgacgcaatgaccccgccgtgtaaaatgctttgcgcccagttgcccaccatcatcggcttatttttaaaggccagctgtgcgaactctttttcgtaacgctccagttccatccccaatgcgcggttaaatggcatgtgataaacaaacatctcacccactaatttgagggcttgttcagcggtcagtacggcagacataacatccttacacttcattagttaatgaaatgttgattttatgcttatttattgttggtttctactttaggaagggataactaacggctatggagttaagtatgtaaaatagcccgcagaaaaatattcaccttatcaataattcgttacggagaacacgagcgatgcggactctgcagggctggttgttgccggtgtttatgttgcctatggcagtatatgcacaagaggcaacggtgaaagaggtgcatgacgcgccagcggtgcgtggcagtattatcgccaatatgctgcaggagcatgataatccgttcaccctttatccttatgacaccaactacatcatctacacccaaaccagcgatctgaataaagaagcgattgccagttacgactgggcggaaaacgcgcgtaaggatgaagtaaagttccagttgagcctggcgtttccgctgtggcgtgggattttggggccaaactctgtactgggcgcctcctacacacagaaatcctggtggcagctttctaatagcgatgagtcatcaccgtttcgtgaaactaactacgaaccgcaattgttcctcggttttgccacggattacaactttgctggctggacgctgcgcgatgtggaaatgggctacaaccacgactcaaacgggcgttcagacccgacttcccgcagctggaaccgcctttatacccgcctgatggcagaaaacggtaactggctggtagaggtgaagccgtggtatgtggtggggaatacggacgataacccggacatcaccaaatatatgggttactaccagcttaaaatcggctatcacctcggtgatgcggtactgagcgcgaaagggcagtacaactggaacaccggttacggcggcgcggagttaggcttaagctacccgatcaccaaacatgtgcgcctttatactcaggtttacagcggttacggcgaatcgctcatcgactataacttcaaccagacccgcgttggtgtgggagttatgctaaacgacctgttttgatgaatggttggcaaatctggaatccagcatccaggattaccctctcagagactaaaagcattgcagtttctcgcgcaggcgctgaaaatagcgcctgtttttatttcaggcaatcggggtgaatgtggcgcaggcggaagtgttgaatctggagtccggagctaaacaggttttacaagaaacctttggctaccaacagtttcgccccggccaggaagagattatcgacaccgtactttccggtcgcgattgcctggtcgtcatgcccactggtggcggaaaatccctttgctatcaaatccctgccttattgctaaacggccttaccgtggttgtctcaccgctgatttcgttgatgaaagatcaggtagatcaactgcaagccaacggcgtggcggcggcgtgccttaactcgacgcaaacccgcgagcagcagcttgaagtgatgacaggctgtcgcaccgggcaaatcagcctgctttatatcgcgccggaacgcctgatgctggataactttcttgagcatctggcgcactggaatccggtgttattagccgttgatgaagcgcactgtatctcccaatggggtcacgatttccgcccggaatacgctgccctcggtcagctgcgtcagcgttttccgacgctcccgtttatggcgctgactgccacagccgatgacaccacgcgccaggatatcgtgcgcctgctggggctgaacgatccgctgattcaaatcagcagttttgaccgtccgaatattcgctacatgctgatggagaaattcaaaccgctcgatcagttgatgcgttatgtacaggaacaacgcggtaagtcggggattatttactgtaatagtcgtgcgaaagtagaagacaccgctgcgcgcctgcaaagcaagggaattagcgcggcggcctatcatgccgggctggaaaataatgttcgcgctgatgtgcaggaaaaattccagcgcgatgacctgcaaattgtggtggcgacggtggcgttcggcatgggcatcaacaagcctaacgttcgcttcgtggtgcattttgatattccgcgcaatatcgaatcctattatcaggaaactggacgcgccgggcgtgatggcctgcccgcggaagcgatgctgttttacgatccggctgatatggcgtggctgcgccgttgtctggaagagaagccgcaggggcagttgcaggatatcgaacgtcataaactcaatgcgatgggcgcgtttgccgaagcgcaaacttgtcgtcgtttggtattgctgaactattttggcgaagggcgtcaggagccgtgcgggaactgcgatatctgcctcgatccgccaaaacagtacgatggttcaaccgatgcgcagattgccctttccaccattggtcgtgtgaatcagcggtttgggatgggttatgtggtggaagtgattcgcggtgctaataatcagcgtatccgcgactatggtcatgacaaactgaaagtctatggcatgggccgtgataaaagccatgaacattgggtgagcgtgatccgccagctgattcacctcggcctggtgacgcaaaatattgcccagcattctgccctacaactgacagaggctgcgcgtccggtgctgcgcggcgaatcctctttgcaacttgccgtgccgcgtatcgtggtgctcaaaccgaaagcgatgcagaaatcgttcggcggcaactatgatcgtaaactgttcgccaaattacgcaaactgcgtaaatcgattgccgatgaaagcaatgtcccgccgtacgtggtgtttaacgacgcaaccttgattgagatggcggagcagatgccgatcaccgccagcgaaatgctcagcgttaacggcgttgggatgcgcaagctggaacgctttggcaaaccgtttatggcgctgattcgtgcgcatgtcgatggtgacgacgaagagtagtcagcagcataaaaaagtgccaggatgaagactccgtaaacgtttcccccgcgagtctaatgtatgttgatgttattcctcaccgtcgccatggtgcacattgtggcgcttatgagccccggtcccgatttcttttttgtctctcagaccgctgttagtcgttcccgtaaagaagcgatgatgggcgtgctgggcattacctgcggcgtaatggtttgggctgggattgcgttgcttggcctacatttgattatcgaaaaaatggcctggctgcatacgctgattatggtgggcggtggcctgtatctctgctggatgggttaccagatgctacgcggtgcactgaaaaaagaggttgtttctgcccctgcgccacaagtcgaactggcgaaaagcgggcgcagttttcttaagggcttactgaccaatctcgcgaaccctaaagcgattatctactttggttcggtgttctcgctgtttgtcggtgataatgtcggcaccaccgaacgctggggcattttcgcgttgattattgtcgaaacactggcgtggtttaccgtcgttgccagcctgtttgctctgccgcaaatgcgccgtggttatcaacgtctggcgaagtggattgatggttttgccggggcgttatttgccggatttggcattcatttgattatttcgcgttaatgccagacgcgtcatcagagtaagtcggataaggcgtttacgccgcatccgacattattttcacgcatgcctcgccgatgctaacagcgctcccaccagcataaataacgagccgaaaatcttattcagcgccttcatctgctttggtcctttaatccatagagcaatccgttgagcaagggtggcgtaaccgatcatcacaataatatcgaccacaatagtggtgacgccgagcacgatatactgcatcagttgtggctgctgcggcatgatgaattgcggaaatagcgccgccagaaacacaatacttttgggattggtgagattcacaaaaactgcgcgctggaacaaatgtcggcgcgattgagtagaggccagcgatttaagatcaattgcgccagcggcgcgccattgctgtattcccagccaaatcaagtaagctgcgcctgcccacttcaacacttcaaacgcaatcactgagcgggaaaatagcgtccccaaccccacgccaaccagcacaatatgaatcgccagtccggtctgaagcccagcaatagacgccaccgcgccgcgataaccgtggttgagcgaggtggtcatggtgttgattgcgccagagcctggcgacaggcttaaaatgatcgatgtcagcaggtaggcaaaccaccattctaaggtcatgatgaactcccggtgtgtctatttttgtgccacaatacgctactgtcgcagcgttgtgtcaggcacgcttaaaaaaacgattttacgtggtttaagaggcagattacccgatgtttcagcagcaaaaagactgggaaacaagagaaaacgcgtttgctgcttttaccatgggaccgctgactgatttctggcgtcagcgtgatgaagcagagtttactggtgtggatgacattccggtgcgctttgtccgttttcgcgcacagcaccatgaccgggtggtagtcatctgtccggggcgtattgagagctacgtaaaatatgcggaactggcctacgacctgttccatttggggtttgatgttttaatcatcgaccatcgcgggcagggacgttccggtcgcctgttaggcgatccacatctcgggcatgttaatcgctttaatgattatgttgatgatctggcggcattctggcaacaggaggttcagcccggtccgtggcgtaaacgctatatactggcacattcgatgggcggtgcgatctccacattatttctgcaacgccatccaggtgtatgtgacgccattgcgctaactgcgccaatgtttgggatcgtgattcgtatgccgtcatttatggcacggcagatcctcaattgggccgaagcgcatccacgtttccgtgatggctatgcaataggcaccgggcgctggcgcgcgttgccgtttgctatcaacgtactgacccacagcagacagcgatatcgacgtaacttacgtttctatgctgatgacccaacgattcgcgtcggtgggccgacctaccattgggtacgcgaaagtattctggctggcgaacaggtgttagccggtgcgggtgatgacgccacgccaacgcttctcttacaagctgaagaggaacgcgtggtggataatcgcatgcacgaccgtttttgtgaactacgcaccgctgcgggccatcctgtcgaaggaggacggccgttggtaattaaaggtgcgtaccatgagatcctttttgaaaaggacgcaatgcgctcagtcgcgctccacgctatcgttgattttttcaacaggcataactcacccagcggaaaccgctctacagaggtttaaatttcttatgtaccaggttgttgcgtctgatttagatggcacgttactttctcccgaccatacgttatccccttacgccaaagaaactctgaagctgctcaccgcgcgcggcatcaactttgtgtttgcgaccggtcgtcaccacgttgatgtggggcaaattcgcgataatctggagattaagtcttacatgattacctccaatggcgcgcgcgttcacgatctggatggcaacctgatttttgctcataacctggatcgcgacattgccagtgacctgtttggcgtggtcaacgacaacccggagatcattactaacgtttatcgcgatgatgaatggtttatgaatcgccatcgcccggaagagatgcgctttttcaaagaagcggtgttcaattatgcgctgtatgagccgggattgctggagccggaaggcgtcagcaaagtgttcttcacctgcgattcccatgaaaaacttctgccactggagcaggcgattaacgctcgctggggagatcgcgtcaatgtcagtttctctaccttaacctgcttggaagtgatggcgggcggcgtttcaaaaggccatgcgctggaagcggtggcgaagaaactgggctacagcctgcaagattgtattgcctttggcgatggaatgaacgatgccgaaatgctgtcgatggcggggaaaggctgcattatgggcagcgcgcatcaacggctgaaagatctgcatccagagctggaagtgattggtactaacgccgaagacgcagtgccgcattatctgcgtaagctctatttatcgtaatcgttctttatttggtcagttgtcaacctgatacttcgctacaatggatactcgttaatcaaagagttttccattgtggcgctacttatcatcaccacgattctgtgggccttctcctttagcttttatggcgagtaccttgcggggcacgtcgatagctattttgcggtgctggtgcgcgttggcctggcggcactcgtttttctgccgtttctgcgtacccgtggcaatagcctgaaaacggtcggcctgtatatgctggtgggcgcgatgcagctcggtgtgatgtatatgctgagtttccgcgcctatctctacctgacggtttctgaactgctgttgttcaccgtactgacgccgctctacatcacgctgatttatgacatcatgagtaagcgccgtctgcgctggggctatgcctttagcgccttgctggcggtgattggtgccgggattattcgctatgatcaggtcaccgaccatttctggactggcttattgctggtgcaactctccaatatcacttttgccatcggcatggtgggttacaaacgtctgatggaaactcgcccgatgccgcagcataacgcctttgcgtggttctatcttggcgcgttcctggtggcagtgattgcatggttcttgctgggaaatgcgcagaaaatgccgcaaaccacgttgcaatggggcattctggtgtttcttggtgtggtggcttccgggattggctactttatgtggaactacggcgcgacgcaggtggacgccggaacgctgggcattatgaataatatgcacgttccggcagggctgctggtaaacctggctatctggcaccaacagccgcactggccaacgtttattacaggcgcgctggtgatcctggcctcactgtgggtgcatcgtaagtgggtcgctccgcgctcttcacaaacggcagatgatcgcaggcgtgattgcgcgctgaacgaataaacgcttctgtaatcggctgacgctgctcgccatcgcgcacggcggcgtacagtcggctccacaagccttcgcccagggttttggtgaccaccagaccctggcgttcaaaactctccaccacccaatgcggtagtgcggcaatacccatccgtgcggcaaccatctgaatcaacaataaggtgttatcgacgcttttcagtgacgggctgacgcctgctggctgaagaaaatgcctccagacatccagtcggctacgctgcaccggataaatcaacagcgtttcgctggcgagatcttccggtgtaatacgcgtttttgccgccagtggatggtcaggtgctaacaccagacgcacttcatagtcgaacatcggcgaataatgcaggccactgcgcggcagaatatcggacgtcatcaccagatccagctcgccctgttgcaacgcaggctgcggatcaaacgttacgcccgatttaaaatccatctccacctgcggccagttcttatggaaactttctaatgcgggcgtcagccactgaatacagctatggcactctatggcaatgcgcaggcgcgtctgctgcggttcattgcaggcttgcagtgcctggctaatttgcggcagcacctgatttgccagttgcaacaggatttctccctgcggtgtaaagcgaagcggctggcttttacgcacaaatagccggaagccaaggcgttgttccagatcgctaaactggtgagacagggcggattgcgtttgatgcaacgtcgccgcagcggctgcgagtgagccgcagttccgcaacgcttgtagcgttttcaggtgttttacttcgatcatgaaagtccttcacttcggcatgaataatttgcgcttgaggaatatacagtaaccgccaattatggatgtgtaaacatccggacggctaaatactaaaaattccataaggggcatataatgacaattcttaatcacaccctcggtttccctcgcgttggcctgcgtcgcgagctgaaaaaagcgcaagagagttattgggcggggaactccacgcgtgaagaactgctggcggtagggcgtgaattgcgtgctcgtcactgggatcaacaaaagcaagcgggtatcgacctgctgccggtgggcgattttgcctggtacgatcatgtactgaccaccagtctgctgctgggtaatgttccgccacgtcatcagaacaacgatggttcggtagatatcgacaccctgttccgtattggtcgtggacgtgcaccgactggcgaacctgcggcggcagcggaaatgaccaaatggtttaacaccaactatcactacatggtgccggagttcgttaaaggccaacagttcaaactgacctggacgcagctgctggaggaagtggacgaggcgctggcgctgggccacaaggtgaaacctgtgctgctggggccagttacctacctgtggctgggtaaagtgaaaggtgaacagtttgatcgcctgagcctgctgaacgacattctgccggtttatcagcaagtgctggcagaactggcgaaacgcggcatcgagtgggtacagattgatgaacccgcgctggtactggaactgccgcaggcgtggctggacgcatacaaacccgcttacgacgcgctccagggacaggtgaaactgctgctgaccacctattttgaaggcgtaacgccaaatctcgacacgattactgcgctgcctgttcagggtctgcatgtcgatctcgtacatggtaaagatgacgttgctgaactgcacaagcgtctgccttctgactggctgctgtctgcgggtcttatcaatggtcgtaacgtctggcgcgccgatcttaccgagaaatatgcgcaaattaaggacattgtcggcaaacgtgatttgtgggtggcatcttcctgctcattgctgcacagccctatcgacctgagcgtggaaacgcgtcttgatgcagaagtgaaaagctggtttgccttcgccctgcaaaaatgtcatgaactggcattgctgcgcgatgcgttgaacagtggtgatacggcagctctggcagagtggagcgctccgattcaggcgcgtcgtcactctactcgtgtacataatccggcagtagaaaagcgtctggcggcgatcaccgctcaggacagtcagcgtgcgaatgtctatgaagtgcgtgctgaagcccagcgtgcgcgttttaaactgcccgcgtggccgaccaccacgattggttccttcccgcaaaccacggagattcgtaccctgcgtctggattttaaaaagggtaatctcgacgccaataactaccgcacgggcattgcggaacatatcaagcaggccattgttgagcaggaacgtttgggactggatgtgctggtacatggcgaggccgagcgtaatgacatggtggaatactttggcgagcatctggatggctttgtctttacgcaaaacggttgggtacagagctacggttcccgctgcgtgaagccaccgattgttattggtgacgttagccgcccggcaccgattaccgtggagtgggcaaaatatgcgcaatccctgactgataaaccggtgaaagggatgttgaccggcccggtgactattctctgctggtcgttcccgcgtgaagatgtcagccgtgaaaccatcgccaaacaaattgcgctggcgctgcgtgatgaagtcgcggacctggaagccgctggaattggcatcattcagattgacgaaccggcattgcgcgaaggtttaccactgcgtcgcagcgactgggatgcctatctccagtggggcgtggaggctttccgtatcaacgccgccgtggcgaaagatgacacacaaatccacactcacatgtgttactgcgagttcaacgacatcatgtattcgattgcggcgctggacgcagacgtcatcaccatcgaaacctcgcgttccgacatggagttgctggagtcgtttgaagagtttgattatccaaatgaaatcggtcctggcgtctatgacattcactcgccaaacgtaccgagcgtggaatggattgaagccttgctgaagaaagcggcaaaacgcattccggcagagcgtctgtgggtcaacccggactgtggcctgaaaacgcgcggctggccagaaacccgcgcggcactggcgaacatggtgcaggcggcgcagaatttgcgtcgggggtaaaatccaaaccgggtggtaataccacccggtcttttctcattacagcggcgtcttcccagcatactgcgtaaaccattccagatatcagttcataccctgtttaagaaaatcttctttattcccttctcatgaaataaatttcgtcatttccgccattttttctatctgcctctccatcacatattaaaaattacttgatatctctatgttttttaatgaaaaacatatcaacctatgatctttcttgtgactagcttcacatttcatactgatgcattggaatgaaataaaatttcatgagattttgtgtttgagaaaaattatttcatgaggtgtgaaatggacgcaaagctgtacatcactgagatcatcaatgaattaaccttcgttaaggactctatccgtgaggatgactgcaccaaattgatcgacgctattcagcaaagccagcgcgttttctgctatggcctgggacgtgccggcttttccatgaaagccttcaccatgcgcctgatgcatatgggaaaagaggtttacttcctgacggaaaccattacgccgaactttgggcctggcgatctgtttatcgtttcttccgcttccggtgagacagcacaactggtggcactggcgaaaaaagcacgtcagcttggcggcgctgtggcggtgttaaccacgaatcgacacgccactatcaccgagtttgtcgatgtcatcgtgcaaattaatgccccttccaaaaatcaaaaagattctgttttccgctcggcacagccgatggcgtcgttgtatgagcaagctttgctggtgattgccgatgcattagtgatgaagatggctgctgaaagtggtgcgccggaaagtgaactgtttaagcgccacgccaatctggaatagtcgtcgccgttatttgctcgataccctacaggagaataaaaatgagcaaaaaaataacatccttgtttaacttcaagaagttgcagaaattttcttctgctctgatgttaccaatcgccattcttccggcggcgggtttgattttagccatcgggatttcatttaacattgagctgctggcgaattgcggcggcctgattttcgccaaccttcctttgctgttttgtgtcggtattgtgattggcctgacaggtgatggttcttcttcactttcagcgattatcagctacatgatcatgaatgccacgatgggtacgcaacttggcattaccgcggagtccgttgcagccagtaacggtgactatgcgatgatcctcggggtaccgacgttacaaacgggagtgtttggcggtttgattgtcgccatctttgtttatctgctctatacccgcttccacaatattgaattgcctcagtttcttggtttcttcggtggaaaacgctttgtaccgattattacggcggtggcggcaattattgtcggctatttattgccgtggctgtggataccggtacaaaaaggtctggcgtcgctttcaacgctggtgaccagtgggcataacgcgaacttcgcggcctttatttacgccgttggcgaacgttcgctgattccttttggcctgcatcatatctggaacgtgccgttttattacaactttggcgactacatgaccaaatccgggcaactggtgacgggcgatattccggtgttctttgcccaattgcgcgacggtgttccgttgacggcggggctgtttatgacaggtcgtttcccaatcatgatgtttgcgttacctgccgccgcgttggcgatgtatcaggaagcaaaaccggaacgtaaggcgctgattaaaggccttttactctccggtgcgctgaccacatttgttaccgggattacggagccgctggaatatgcatttttgtttgcagctccggttctctacatcattcacatcttcttatatgccacttcatttgtgctgatgaacatcctgaatgtgcacattggtcatccttttgctggcggtcttattgatttcgtactgaatggcgttatgccaaaccgcacgccgtggtatctggtgttcctggcaggcgcgggctatgcagcgatttactacaccgtatttcgggtactgatccgcaagttgaatctgaaaacaccggggcgtgaggatgaagagattgccgttgcaaccacattaacgcgcgaagaacgtccataccaaatcatcgaagcagtaggtggtttcaacaatatcgaagatgtggatgcctgcgcaacacgcctgaggctggcgctggtagacgataagaaagtgaatgaaaaacggctgaaggagttgggggctgcgggtttagtgaaactgggtgatggcggtgtacaggtgatatttggcggcaaatcgcaaatcctgcgcgacgaaatcaaaaccgtaatgagcagaccgcgcccgacagaaatgacagtggcctgtgctaactaattcgagattagcgggctggtttcagcccgccagacagagagagctgaagtatgaatttacaattactggctaatgccatccgaatgttaagtgttgatgcgatccagaaagcgaactccggtcatccgggcgcgccgatggggatggcggatattgccgaagtggtctggcgtcgtcacctgcgtcataacccaaaaaatccgcagtggtttaaccgcgaccgctatgttcagtcgaacggtcacggctccatgttgatttacgctttgctgcatcttacaggctacgacctgtcgatggatgatattcgcgactttcgtcagctccactcccgcacgccgggtcatccagaatatggttatacgccgggtgttgaaaccaccaccggcccgttggggcagggcgtagctaatgcggtggggatggcgattgcggagaaggcgctggcggcagaatttaacaaaccgggctttaatattgttgatcatcacacatggctatttttgggtgatggctgcctgatggaagggatctcccacgaggcctgtggtcttgcaggaacgctgaagctcggcaatctgattgctatctgggacgataacggtatttcgatcgatggtcacgtagaaggctggttcgctgaagatacggctgcccgttttcgtgcctacggctggcatgtcattgaaggcgttgatggtcacgatccagaagcggtagatgctgcggtgcgtgaagcgaaaagcgtcacggataagcccagtctgctgtgctgcaaaacgattatcggttttggttcgccaaataaagccaacagccacgattgccacggctcggcgctgggtgcagatgaagtggcgctggtgcgtgaacgtctgcaatggccgtatgcccctttcgaaattcctggtgaaatttatgccgaatgggatgcgaccgagaaaggcgcgcaggttcaacaggaatgggatgcactgtttgccgactacgcgaagcagtggccggaactggcggcggagtttactcgtcgcatgaagggtgatttgcctgctggctgggccgagaatatgcagaaatatgtgcacgatctgcaatcccatccggcggcgctggcaacccgtcaggtcagccagaaatgcctcaatcacttcgcggatatgctgccggaactgatgggcggctcggcggacttgtcgccctctaacctgactcgccatcagaaatcggttgatttcaccggggaaaatccggcggggaattacatctcctatggcgtgcgtgaatttggtatgtcggccatcatgaacggtcttgcgctgcatggtgggtttatcccttacggcggtactttcctgatgtttatggaatatgcgcgtaatgcactgcgcatggcggcgctgatgaagatccgctcggtgtttgtttatacccacgataccatcggcctgggcgaagacggcccgacacatcagcccgttgagcaactggcgtcgctgcgtctgacgccgaatatggaaacctggcgcggttgcgatcaggtggaagtggcggtagcctggcaacaggcgattgagcgcaaagatggcccaacgtcgttggtattaacgcgccaacctctggcgcaacagccgcgcaccgctgcacagttggcagagattgcgcgtggtggttatgtactgagtgattgtgacggtcagcctgagatgatcctcatttctgcgggttcagagattgagttagtggtcagcgccgcaaaagcgttaacggaagaagggcgtaaagttcgcgtggtttctatgccgtgtaccgagcgtttcgataatcaggatgcggcgtacaaagaatcggtattgccaaaagctgtacgcaaacgtctggcggtagaagccagcatcgccggattctgggaacgctacgtgggcctggacggtaaagtgatcggcatgacgagctttggtgagtctgctccggcgaatgtgttgttcaaacactttggtgttacgccggaaaatgtcctggcgcaggcgcgtgagctactgaacagctaaacctgcacaaggggtgaaaggatgaccttttaccccttgaaacgggagccaagaaactcttcacgggtgcggtatttctcgtaatgcgccttgtttttatacataaacaacagcaccagcatatcaataacgcccattgccggaacgcgagtggagtcgaaggcttcaaagaagattttatcgctgaccgcggtattgagttgatgggtggagagttttgataacggagatttaatatagttagtgatacaaacggatttggcaccgcgctctttcaccactttaaagatatcgaccattaagttggtgctgccagagttagaaataccaatcgccaggtcgcgtttccccatagaatatgccgcattaatttgcatttccgggctgacgtgaacaacggtttttaatccgagttggctgaatttataagcaccataaacggccagagggtttgaatttccagcagcaaaaaagaaaatagtatcgcaattagcaagtagtttgagaatggactcaagcacttcggcattaaaaaattgcgttgattgtattaaatcttcggcctgtttttttaataagaaggttgccaaagatgttatatcgctgaagtcggtattttcaggatagctattgtcaggattaatgacttcttttgctaatgcaatttttaaatggtaataaccctgataacctaatttcttacaggtgcgtacgatagtcgcttcactggcatggcttttttctgatagttcagtgacactatagttcacgacttcatgtgcgtggctaagaatatagtcagcgacctttttttccgcctgatgcagtgtagggtaattgctttgaatcagactttttacggttatgttattcataattagtaaatttcattctgacagaaagtgctgattataacatagttttcaggcgtggataggtgtgaaaaaatgaaggtgtgcagtgaacgtaatgattaacagaccggttaattttcatgaattacgtcaactgcacaaaaataatttaaacgggcgctctaattaaagcaagacttatatttttatcattgtattgtcaattaaatacaaattgtgtcattaattgtgggtttcttaaatattctatgcaccactgacaggctttgcccataccatcggaacgagcggcaagaaataacttggtggcgtgtttatgttcgcgcattggctttttaagcaatttaccgctgttcaataacggcaatgccagatgatgtggaatataaccaataccgacgttttgttctattaaggcgattgccgtagcgaagtcaggaacaaaaatgggtttttgtccttccaacaaccaggcttgcatcggggggaagttaacggaggtatcgcggatacaaaccgctggataatgacgcaattcactgttttctaatggatgccgcttcgctgccagtgggtggagtgggctgacgacaaaatcccattccatttgtccgaccggttcgctaatgatgctttcactgcttggtactgcatgaggagcaccgtagaccagatcagcacgcttactgtacagcgcatcccagcagccgttgtatacctcaagatctaccgtcagtgttgttgatgtgaattgccgttcaaaatctcgaataaatgccaccagcaaatcaccaggaataatattgtttaccgcaattgtcagttcacgctcaataccatcgtgaatcagcactgtgttgcgctttaatgcttccaggtcgccaagaatagttttgctatgttcgatgaagtaacttcccgctggcgataattcaatatagcgtcccttacgaatgaacagttcaacgcccaggctctcttccgctttcttgatagtgtaactgatggcggaagggactttatttaactgctcggctgcggtggtaatgctctggtgtctggcgaccagatgaataacacgaagcgtttcgtctgagatgaacataaggctccctggtcagtggtaaagtggctgaatctctccagattcagccgtaatcattgcctgagtatacccaggaattagcggtgttgacttgcccgactgagaatcgcatacgcgatacatgccaccagaatcgagtctaccgaagggatcgtcgtcagggtgaataagccttttacggtcataaagccaaccgctgcgcctatgatccatgctgcgaatgtcagcactttaatctgtgactcctgggctaacactgactcttgatagccattacggcgataaaggaaaaagtcagcgatataaattccggcaacgggtggcgtggcgatacccaggaacagcagaaacggaataaaccacgccataatatccatactgcctacgatggcggaaaggatacccagcgccacggtaatctgccatttgggaaagcgggtaagcagtgtggaaaccaccagcgtgccctggaacatattgcccgcgttaccggtgacgcaggcgaaaatcaacaacagcgccgcaggcagaaccgcaccgaataccgccatcgcacccagtaaagatccctgaccactaatggcgctcggcgttgcacccgcccagtagagcagagggtaggcaaccagaaacgtcatgcctgcggcaatcagcgcatgtttgcggttatgcacaaaactaccgaaatcaggcagtgtggcaaccagcacaataatggtgccaacaacggtggaaacggcgacacctgtattcatctccacaatcgccgctggtactgccacttcggtatgggttgccacatagaggatgtaatacagcaccagcgcgataaccggcacggcaacctgggcaatttttcccagaacggcaaagccaaatgccgtagaggcgacaaaaatgacacagccagccgctactaacagtgccagtggaacttccagtccatgttgagccagtaagtcatgtaccgaatgaccaaacatattggcggtaacggcaatccagccgaacagacttatcgccatcaaaatgttaatggcgatggcccctttttcgccaaacgaatatttcacaatgccatacgttggcaggcgggctttttctcccacgctaatggtgatggctgaaagtaaggtcagaatgacgccgcctaacaatacgacgctaattaaactgccgctggaaagttgattgccgaggcttgaggatgacaacagcacaggtgtgacggcaatacccagcaaaatcatggcaatacgcaatcctgatgccgtattcagattctcttcttttttacgcatagtatgttccctttataaatgcgcgttacacagtatgaaaatgcccggtgtatttgcgccagctacccagttctgtaatttcccgttggccttcggtcagccagttttctgccagtacgcccagcacttcgctaccatcggcaagtttgattttgccaattgccagcccagcgggttcgctcattaacagagcggcaaaactggccagcggtaattgccaaatttctacgtcgacgtgtgttcctccttcattcacgcgaatcattcccggatggcgatcattaatactccacaaccggtaatgggcgtcagttcggtcttcacggacaaaaataccgcccgctttttgcatatttgggttgagttccaggccgcgcatcagcgttccgttaacggctaaaagcgttgtagtcattgtgttctccagagaattaaagggttatccatgtaccgctctgatgcgccagggctgcttttatggtttgcggtgaagtaatcaggccgctggcctgtttgccttgttgctggctggcattgatgaaatcaacaatggcttccactttgggttgcatactgccgacaccaaactgaccttcccgcaacagcgtttgcgcttcggcaacgctgatagcgtcgagccactgttgttgtggtgtaccaaagttaatcgccattttttctacaccggtggggatcaccagcagatctgcgcctaactgactggcgagcagcgcggaggccagatctttatcgatcacggcttctacacctttcagttgttgcccgtctcgcaccaccggaataccgccgccgccgcaggcaataaccagatatccctggcgcaccaggtgagcgatggtgtcgtgctcaataatttccagtggtgcaggagagggaactgtacgccgccaaccacgcccggcgtcctccatcagcgtccagccgagttgttgttggcgttgttgggccgttgcttcatcgagaaacgcgccaattggtttgctggggctggcgaaagcatcgtcatgtgggctgactcgcgtttgtgtcaccagggcaattaccggtttgtttatgccacggcgagccaattcgttatgcagcgctttctggaacatgtagccaattgcaccttgtgtatcacccacggcgtaatcaagtggaaccggagaaacttcgttactggcgagttcagagcggcgcagaataaagcccacctgcgggccattaccgtgggttagcaccaggtcccatccggcttcaaccatatcaacgatatgctgcacgctttccatcactgcaacatattgatcggggatactattgcgttgctcgtcctgaatgagcgcattgccgccaaccgcgacgacagccagtggcttaaccatgatggttctcctttgcgacgatctccgccagtgcacgtacagcggcgacaaaacaggccatcggcgcagtggtgatcccggcaccaatttgcccgacccccgcttgtttgtgggcgatacccgtattgatgaccggtaaaatgccgcgatcggtcactttacgcgcatcaatccctgctgcggtgggggcaaaattgagggctggaagtgtaaatgcggggttaccgccgagggtgatggcttgcatccgacggctgttattggtggcatcgacaggggtgcctcccacaaatttgacgatcgccggagacgacgccatcgcgaagccacccacacctgcggtttcagtaattgcgctatcacccaggtcagcagcagcgtcgtcaacgccaaatccggggaagaacagaccttcaacggcattggcaggagcctggaaccagcgatcgccagtaccggaaatccgaataccaaaattcaccccgttacgcgccatcaccgtaaccattgaactgaacggtacattggcggcggcatccatcattgctttacaggcggccatcgacagattgaggaagaagtgatcgttaccggtgataaatgccacgacgcgctggatatgttcctgtggaagagagcaggccagcaatgccgggagcaggcgcttaatcagcaaaccggtagcggcagcattgcggttatgaacttcatcccccatatgcagcgcctgcgccattaatggcttgagttccagctcgccgtgttgtgcgattgctgctttcattgccggcgccagttcatcgcgcatccaggccagacgattgagaacttcatcgttattggcgccaaaacggagaaccttacccagaccttcattgaaattgctaaaagtacgatggccgttggttttgttttctaccacccataacggcatcgacgggctgatgatgcctgccattgggccaaccgcgtgataatgatgacaaggggcaaggtcgatttcgcctgcgtttatttggttttcagcgtcttgctggctggtggcccaaccttcgtacagcatggcaccaataatcgccccttttaccggaccacacatctcttcccaggcaatcggcgggccagagtgcaaaatacgtttttgttcagccattgctggaatggcctctttagcgagcatgacatccaccagcatgggctgtgcttcgagataacgtgtcatggcgatttggttggcattttctaccaggggatgacgtagcaacgatgccagatccaatccagcgtcaatatcgccttgtgctggtggctgccagttgagtgcaattgcgcttcccccggcatgttgaatattgtcagcaaaactgtgtagtcccgcgttcacaaccttcaaaggctgattaaataaggtattcatgcgtttagcccctttttctgcaactgagtctgtgcaacggtgctggcccatagcgccgcctgtgcattgctgctggcgatgatgacccctgcattttgtagtgctcttatctgctgactgcgtatttgcggatcagcttccgttccgcaaacgtgcgcaatcagcaacggtgcgttattcatgtcgatgtgtgaaagttggtccagtaattcgctggcaggcgtcgtggaagcgccataaccaagtaccaggtcgaataacacgacggcagtgtgtgagtcgttgagttcgttgagcagacgttgattgcgcagagtcgggtcgatcattggatgcggtttgccacgggtgaaatcatcgtcgcccatatcgatcaacgtgtgatcttcgctttgccagatatttgccagagcactattacccgcaactggcgtattggaagctgcgctgaatcccttttgttggcagataagttgcgcttcgtagcagaaggttcctccggcgaaaacaccgcgtatcgcctggcgatgggctggcaggcgctgacaggcgttttgtaacattgtgagatcggcgcaggaaatctcggtctcgacagccggaagtggttgatcattcagtaacgccacggcgatgttggcggcgctggcaagtgtggtggccgcggtgatattgggacgtgccagatcatgcggattcgcaccgaggaaattcaccactacgggttttccacaagcctcggcacgctccagaatagtccgggcaacgatcggtgaaggcggttttgatataagcacaatcacgcgagtttcatcgtcttgcgccagcgcatctaaagcgaagagcatcgatattccaccaatctcttcactgagatcatgcccaccggttcccaacgcctgagaaatacccgctccgagctggtcgattcggcaagtcacttcctgtagcccggtgcctgacgcgccaataacaccaattgctccgcgtttcaccacattagcgaagcctaacggaatgccgttaacaatggcggttccacagtcaggtcccattacgatgcgctgacgttctcgggcaagcgttttgatggatttttcctgcccgatactgacgttatcgctgaacatcatcacgttcattccgaggtttaacgctttaattgcttcggcggcggcgtagtctcccggtacagaaatgagtgccaggttggcttcgggttcggcttccagtgccatttccaggctgaccttttccggtgatttaatgccactatccgtttcatcatcgggtttgctggtcagacgttgctgggccagtaccagtgcttcattgcaaatatcttcttcacccatgactgcaatcactaaatcattgggactggcgttgatttcgttacccagacccgcatcgcgcaattgttcgagattattgggcgttcccatgacgaccgaggcctgttgaataccgggcaacttgctgatttgcgcggaaatctgcatcagagaaactgagtcctgataaagattactgaaaactttatatttaactttcatgctgttacgcctgtttcattccgcccgatagcaaaattcgggcaaagcatccccgtgtagccccataagcgggctacgggagaaaaggttgaaatcaattcatggtgttcagggttcgaaagccatgcagcattcctgcaaggcaatctactcctgacgttgcgccaaattgcatgacctgttctgcacaggatgcgattgtcattgccgatgcgctcccaaccagttgtgcgagtaactggcaaatcggttctgaaaaatgtccctgaagcgcacgctccagataatgacgactgatatccgtggtgttgtgcgcatgttgatcaattgcctgctgcaaccggtattgatgatcggcaagtggtgcagggagttgccataaccagagtgctgccagatagcccaacaaatagtcatctccatcgggcgttaagcctttaccaaagccgatcagttgtggcacctggcgttccagcgcatctggatgctccataatcgctaatccctggtgcgtgagactatccggcaggtgcaatgtgctttgaacgttatgctccagacaaaataaaagccgttgcgatgccatcgttgggtagtgctggaaaaccaaagggaatgcctcaaatgtcagcattccccccacaaatggcgactgccagagcgttgcgttatcgagcgccacacaaaatcgaggtgtccgcagtaagccttgggttaactgaacgggatcggaatgggcaatctctcttcgccagtcccaacattcaggtagccagactctggcagcatcagggagattcagatacgtttgcgcacacaacagagtgatgaatgttcccgcgtctgaatacagatttaccgcatgtttaaaagcgctatgtagacgtaaatcttgcgtttcattctgcgggaaaagatatcccaacgacgatgcgcaaagcgtaacctgtaccatcggcgttagccttccagacctgcaataatggctttggaatcagtaacccaaccgaaaatggcaccttgtgctttgatcatctcgagggcgtatttctggaattccgggaaataggagccgacacaatcttctgggataatgcattcatagccacgatcatttgcttcgcgcacggtggtggttacgcaaacttcggttgttacaccacaaactatcagcgtcttgataccgtggttttgcaaaatcagatgtaagtcggtttgataaaacgcgcctttgccaggcttatcaatcaccggttcgcctgccaccgggtacagttcaggaatgatgtcatgacctgcttcacctctgaccagaatgcgtcccatcggtcctggttcaccaataaaggtttttccgccgcgcgtcagtttggctggcgggcagtcgcttaagtctgcacgatggccttcacgagtatgaataaccataattcctttttgacgtgcggctgccagcacctctgtacatggtgcgatagccgtgcgtaccagtgaaacatcattgcccagtgcctcaccgaagccccctgcttcgacaaagtcacgctgcatgtcgatcatgaccagtgcagttgtgcgcggatcaaaaggtaattcaaagggttgagcctgaaaaatggattgcgtcatggtaaatctcctgtctgatgtttaaacgatccagttgttctgagaacgagtattcaggagaaaagcggcacaaaacaggaaaaaagtttgccgcacagcaacgaaatttttgcattcagcaggtggtgtgatgacgaatgtgaagggagtcaaagagtggcatacagcaacaaattttttgatgctgtatggttttgagattaaaaaaatcgttgaaattgtgtgagcttaatcatcagatttagcgactatggcgttactttttaacaccatactgtgtaaaccattccaacattcgctgccagccgtctttcgcagattcggcatgatagctcgggcgataatcggcgttgaacgcatgccctgcatccgggtacacgataatctctgctttcgcgtttgctgcccgcagcgcctggcgcatcgtttccacgctctcttgcggaatgctgttatcctggccgccatataagccgagaaccggcgcgttaagatcggttgcgatatcaacaggttgtttcggtgaattcagcgacttatcgcccgtcagtttgccgtaccacgccactgcggcttttagctgtggattatgcgcggcatacagccaggtgatacgtccaccccagcagaatccggtgatcattaaacgatgaacatcgccgccgttgcgggaagcccaactggcgacatgatcgagatcggccagcacctgcgagtcaggcacttttgctaccagaccgctaagcaacgtggggatatcggcaaaatcattcggatcgccttcgcggaagtaaagttcaggtgcgatagccagatacccctccagcgccagacggcgacaaatgtcgcggatatgttcatgcacgccaaaaatttcctgcactacaatgaccactggcagtgggccatcgctttgctttggtctggcatggtaagcaggcatgttatccccttgtgaagggatagaggtgaagcccgccacaatcgcgtcgtccggagtctgaacgatggtcgaagcgagaggcgatgcagcaggtgcaaatccagattgttgtgttgttgccatggtattctccgtacccttataaaaatgttgcgcaatgttaactatagtcagcatgcaacaaatcacattgcctgaatcggctcatcttttatgcagtcctgcagaatgaagagtgatttatgtgatttgcatcacttttggcgggtaaatttatgcaacgcattttcgtcatggtgatgagtatcacgaaaaaatgttaaacccttcggtaaagtgtctttttgcttcttctgactaaaccgattcacagaggagttgtatatgtccaagtctgatgtttttcatctcggcctcactaaaaacgatttacaaggggctacgcttgccatcgtccctggcgacccggatcgtgtggaaaagatcgccgcgctgatggataagccggttaagctggcatctcaccgcgaattcaccacctggcgtgcagagctggatggtaaacctgttatcgtctgctctaccggtatcggcggcccgtctacctctattgctgttgaagagctggcacagctgggcattcgcaccttcctgcgtatcggtacaacgggcgctattcagccgcatattaatgtgggtgatgtcctggttaccacggcgtctgttcgtctggatggtgcgagcctgcacttcgcaccgctggaattcccggctgtcgctgatttcgaatgtacgactgcgctggttgaagctgcgaaatccattggcgcgacgactcacgttggcgtgacagcttcttctgataccttctacccaggtcaggaacgttacgatacttactctggtcgtgttgtgcgccactttaaaggctcgatggaagagtggcaggcgatgggtgtaatgaactatgaaatggaatctgcaaccctgctgaccatgtgtgcaagtcagggcctgcgtgccggtatggtagcgggggttatcgttaaccgcacccagcaagagatcccgaatgctgagacgatgaaacaaaccgaaagccatgcggtgaaaatcgtggtggaagcggcgcgtcgtctgctgaaataaaaaaacgctccccaacttcggggagcgatatcagttattgacgccgtaaacgcattattttgcggattattggcgtcagtagcgtaaaggcggccagagtcagcaatgccagagtgatcggtcgggtatacagaaagtcgagtgacccaccagaaagcgacagcgcacggcgaaaattactttccgccattggccccataatcaatgccagcactacgggtgatgccggatatcctcctttctgcatgaaatagcccaccacgcctgcaatcagcataatgccaacatcaaaaaggctattgttcaacgcataagtcccgaccacacaaagtgcgaggatcatcggtgtgagaatattgccgggaattttcaccacattaccgatgactttcaaagagagcagtccaagaactagtagcatgaagtaacagaagatcatgccgacaaacagcgtataaaccatatcaccgtggtcggtaaacatcagcgggcctggttgcattccctgtaacgttaacgcgcccagcatgacggcggttaccgcatcgccagggatccccagcgtcagcataggtaacaatgcgccaccggtgcagccattcgcgcctgcctcacaggaggccacagctttaatttcacccttaccaaagttttctggtgtcttactgaaacgacgagtttcgttataggcaacaaaagctgcaatatccgcccccgcaccggggatcatgccgataaaaacccctaatcctgatgagcgcaaaatggttaatgcaatgcggcgtagtgtttgccagggcagtaacagactgccgatagccaccttcgcgccctgacgaatttgctggttttgctccatagagcgaaatgcttctgaagcagcaaataaaccaatcatcaccgggataaatggcacattcatcagctccacaaatccacctgtaaaccgtggaaaaccgcccattggatcaaggcctatcgttgcgatcagcaatccgccaaccccggcaatcagccctttaatcagtgactcaccggaaatactggcaataatgctcagtccgaaggttgccagggcgaaggactccgaggcactaaatttcagcgcccaactggcaagtaccggagagagaaacatcagcacgataatgctgagcgttccgccactaaaggaagagaacgtggcggcactcaatgccagccctgcttttccctgtttcgtcagctcataaccatcaatagcggtggctgcggcggcaggcgttccgggaattttgagcaaaattgcggtgatagaaccaccgtagacgccaccaaaaaagacgccgcaaatcatcaacaatccagaaacaggctccatgccgtaggtgaaaggcagcaaaattgccacacccatggtcgctgtcagaccaggcaaagcgccaatcacaatacccagcatcaccccaaaagtggcaaacagcagcgcctgaggattattgagtaatgtcgaaaaaccctgagttaaaagttcactttcaaacattgctggcccctgttattcgaaaaatgtgccgacaggcaatggcacctgtaacgcttcgacaaacagcaaccagaggattgccgttaacagcagcgcaatacccggtgtgagtacccatcgcctgtagcccatcaacgtcataatgacgatgaggaaaacaggagtagtaatgagataaccgcagtagctcatcgccacaatataaaacgcggttgccgcaattcctgttgctgttttcctgaatgccggtttttcctgtgcgttggcgcaagaggctggttttgcctgcaaaagatcgcgtatcaccagcaagacagcgagcacaatcagggcacaggcatagaaggtagggaaggcacttgcaccgggatccgtttcaatggcagttgctggaaaatcagcggcattaatcatcaccgcgccagcaaccacacaaagtaacagcgccaccaccatcgttgatgaaaggcgcttgcggtgcggtacggcgagttgagcaacagactgttttgtgttcatcaaccgtacctcaggtttattttttcaggcccaggcgagtcagcaactcgtcaaagtacttttcctgttcgctgatttgggtctggaagctggcagcgtcaagccatgcatagttgagattcaacttttgcagtgcatcctggaatgcaggctcttcagccgtctcttttgctgcctttgccagaacatccaccacatcctgcggcgttttttgcgacacaatcaggccgcgccaggtgccgatggagagatcaacgcctttctcttttaacgtcgggacgtcaggcatggttttcattcgctcatccgccatcactaccagtgtcttcagcttgccgccattcacatggttgataacttctcctgggcttacggaaaccgcttcaatatgcccgcctaacaggcctgtaatggcaggggctgcgccgtcatacgggacatgagaaaactttgtgcccgttttgtcttccagtgcagctgccgccagatgccagatagctccggtgcctgagttaccaatgcgtacttttccgggattcgctttggagtaagccataaattcttcatagctattccacggcgcatcggcacggactgtgatagcagccggatccgcattcagacgggcaatgggtttaaagtcgctggttttaaaacgcaccattccgaggctgggaagggtggtcagttcaaccgtgcctaaaccaattttgtaaccgttagggcgggcagcggcgatttcactcaggccgatagcaccgcctccgccaggtttattgataaccccgatgctgacgggtaaatggtttttggcggcatcagcaaaggcacgggcaaccagatccgtaccgcctccggcagcgtagggaacgactaactcgatctgtttggttgggtaggaggcagcctgtacaggcgcaatgctgagggcagcgcctgcaagaagtaccattgcagccatttttttcggtaaggtaagatgttttatcattgcttttatatccttatttatcagttagttgctatttaaattgttccatgcgttcataaacagtactgcattttcatagacttgctctggcgtcatgccggggcgatatagcgcagaaccgaggccaaagccgtttgcgccgtggctcagataacgcgccatggtttccggtgtgataccgccaaccggtaacatcggaacggattgtggaataaccgcacgccaggctttggtaacttctggcgtaatttgttcagccgggaacagcttgatggcattagcaccatgttcaatggcagcaaaggcttcggtgggcgtggcgacgccaggcgcacaatacatacccagcgcacgggcgcgacggatcaccgcagtatcgcaatgcggcatcacgataatctggcccccagcctctttaaccgcaaccacctgctctaccgaaagcacagttccggctccgaccaggcagtccttaggcagggcgtcgcgcagtaaactgatactttgcaacgcctccggcgagttcataggaatctcaatcaggcggaatccggcggcgtacagtttttcaccgatggcgacaatctcatccggtttcacgccgcgtaaaatggcgactaacccggttttttgcaaaagtgtattaaatggcatgggtacattccctggcgttggtggacagtaacccggcagcgtgggcgattcgccataatccatgttcagtggcattaggaatggcgtgtatctgtctgtcgggaaaaacgtggctgaatgcttgtgaatagcggctgttcagatttgcgctaccaattaaggcgatcggtgttgtggcgggtaaatcacgtagcaaactggatgccagaccacataattcatggcctatcagtaatccggaaaggtaatccccctgcgaggacgacgtaagattactggtcagcaggcgcgaacgggtcgaaaacagcgtcgataataatccggtctgatgatgctcttgtgctgctgtcagcccgtgggtgaaggcatcccagtgcggttcatctctaggatgcatggtggcaccgagaatcgaatggcgggataaaacatcaaataactcgcccgtcataaaggttcggaaatcggtaatggtgttgttttcaactactgcccatttcgcatgtgtgccgggtaagcctatcagcactggcataccctgatggatcgcgttttgcagggccggttccatcgagatagcaccgaagatttgtgtctcttcgccacgcatcacttcaggcatttcaccttctttaatcacgccaggaatgatgtgcagcattgtctgctgctggtggataacaggcgtcaactgcttcgccagaccctcgagagtgaccgggcaaggtaaataagctgctgattgccacccttgcgcactgccgagcatgccgcaagccagtaccgggcatggggtttgtgccagccagtcgccgcagacacgtaaaaacgtatcgtggaaagcgtcctcacgtgttgctgcctgggagggtaatttcatgatcccccaggggaattcacgtttttcttgtggatttggtgattcgccaaaacgccatgcccgaagcgatgacgttccccagtccagggcaataaatgagggtgctcccggcattagtcgtttcctttaatcatggtttatttatctttgcggacgtgcttaccccagcccagttcagcggatatctcttctgcacaggatttgacgtaaggtgccagttcttccagacgcgccagcgacatatacgtggtggtactggcgacagaaatagccgccacaatttcatcccgggcgttgtaaaccggcgctgcaacgcaacggatagtcggctcgttctcttccagatcaaaagcaaaaccactggcggcataacgacgcatgttctgaataaatgcgcccagttttgtttcatcaccacaggtcttaaacagcgtgcgccactcttcttctgttcggttgaggatcaatgccttgccgatgccggtgattgccagtggcatgcgatggcctgggcgtgagcgcatttccagcccgcgctgactgttgatcttctccagatacagcacttcgtcgccttcaacgatccccagatgcacggtgtccagggtgtaacgggcaaggcgttgcaaaacgggctgggcaatttcgtacagcgaggtgctttccagtgctctggcaccaaattcgatcagtttggcacccagttggtagccctgcgttgggacatggcgcaggtagcgttgttccaccagaacggtgactaaacgatgggttgtgctccgggtcgtgccggtgaactcgccgatactttttaggtcatggcagccgttataaacagcattaagaaccgccagtccacgtaataacgtttgtgcgcctgcggtggttgaagaggtttctgccatacgtttctcctgatgatattgctgaagtgttccacataatgacgtggggaaaaggtgatatatcccacaatataaactccatctcatattgtgggataaaataatgaaaattaacgatcgttttgcgtagcgcctcgcaggaaacttctttcaaactggacgtttgtacagcacaattctattttgtgcgggtaagttgttgcgtcaggaggcgttgtggatttctcaatcatggtttacgcagttattgcattggtgggtgtggcaattggctggctgtttgccagttatcaacatgcgcagcaaaaagccgagcaattagctgaacgtgaagagatggtcgcggagttaagcgcggcaaaacaacaaattacccaaagcgagcactggcgcgcagagtgtgaattgctcaataacgaagtgcgcagcctgcaaagtattaacacctcgctggaggccgatctgcgtgaagtgaccacgcggatggaagccgcacagcaacacgctgacgataaaattcgccagatgatcaatagcgaacagcgcctcagtgagcaatttgaaaaccttgccaaccgtatttttgaacacagtaatcgtcgggttgatgagcaaaatcgccagagtctgaacagtcttttgtcgccgttgcgtgaacaactggatggtttccgccgtcaggtccaggacagctttggtaaagaagcccaagaacgtcataccctgactcacgaaatccgcaacctccagcaactcaacgcccagatggcccaggaagcgatcaacctgacgcgtgcgctgaaaggcgacaataaaacccagggcaactggggcgaggtagtattgacgcgggtgctggaggcttccggtctgcgtgaagggtatgaatatgaaacccaggtcagcatcgaaaatgacgcccgctcgcggatgcagccggatgtcatcgtgcggttgccgcagggaaaagatgtggtgatcgacgccaaaatgacgctggtcgcctatgaacgctatttcaacgccgaagatgactacacccgcgaaagcgcgctacaggaacatatcgcgtcggtacgtaaccatatccgtttgctgggacgcaaagattatcaacagctgccggggctgcgaactctggattacgtgctgatgtttattcccgttgaacccgcttttttactggcgcttgaccgtcagccggagctgatcaccgaagcgttgaaaaacaatatcatgctggttagcccgactacgctgctggtggcgctgcgcactatcgccaacctgtggcgttatgagcatcaaagccgcaacgcccagcaaatcgccgatcgtgccagcaagctgtacgacaagatgcgtttgtttgtcgatgacatgtccgcgattggtcaaagtctcgacaaagcgcaggataactatcgccaggcaatgaaaaaactctcttcaggtcgcggaaatgtgctggcgcaggcagaagcgtttcgcggtttaggggtagaaattaaacgcgagattaatccggatttggctgaacaggcggtgagccaggatgaagagtatcgacttcggtcggttccggagcagccgaatgatgaagcttatcaacgcgatgatgaatataatcagcagtcgcgctagcccattgggggtagttaagccgggtagaaatctagggcatcgacgcccaatctgttacacttctggaacaattttttgatgagcaggcattgagatggtggataagtcacaagaaacgacgcactttggttttcagaccgtcgcgaaggaacaaaaagcggatatggtcgcccacgttttccattccgtggcatcaaaatacgatgtcatgaatgatttgatgtcattcggtattcatcgtttgtggaagcgattcacgattgattgcagcggcgtacgccgtgggcagaccgtgctggatctggctggtggcaccggcgacctgacagcgaaattctctcgcctggtcggagaaactggcaaagtggtccttgctgatatcaatgaatccatgctcaaaatgggccgcgagaagctgcgtaatatcggtgtgattggcaacgttgagtatgttcaggcgaacgctgaggcgctgccgttcccggataacacctttgattgcatcaccatttcgtttggtctgcgtaacgtcaccgacaaagataaagcactgcgttcaatgtatcgcgtgctgaaacccggcggccgcctgctggtacttgagttctcgaagccaattatcgagccgctgagcaaagcctatgatgcatactccttccatgtgctgccgcgtattggctcactggtcgcgaacgacgccgacagctaccgttatctggcagaatccatccgtatgcatcccgatcaggataccctgaaaaccatgatgcaggatgccggattcgaaagtgtcgactactacaatctgacggcaggggttgtggcgctgcatcgtggttataagttctgacaggagaccggaaatgccttttaaacctttagtgacggcaggaattgaaagtctgctcaacaccttcctgtatcgctcacccgcgctgaaaacggcccgctcgcgtctgttgggcaaagtgctgcgcgtggaggtaaaaggcttttcgacgtcattgattctggtgttcagcgaacgccaggtcgatgtactgggcgaatgggcaggcgatgctgactgcaccgttatcgcttacgccagcgtgttgccgaaacttcgcgatcgccagcagcttgccgcactgattcgcagtggtgagctggaagtgcagggtgatattcaggtggtgcaaaacttcgttgcgctggcagatctggcagagttcgaccctgcggaactgctggccccttataccggtgatatcgccgctgaaggtatcagcaaagccctgcgcggaggcgcaaagttcctgcatcacggcattaagcgccagcaatgttatgtggcggaagccattactgaagagtggcgtatggcacccggtccgcttgaagtggcctggtttgcggaagagacggctgccgtcgagcgtgctgttgatgccctgaccaaacggctggaaaaactggaggctaaatgacgccaggtgaagtacggcgcctatatttcatcattcgcacttttttaagctacggacttgatgaactgatccccaaaatgcgtatcaccctgccgctacggctatggcgatactcattattctggatgccaaatcggcataaagacaaacctttaggtgagcgactacgactggccctgcaagaactgggaccggtatggatcaagttcgggcagatgttatcaacccgccgcgatctttttccgccgcatattgccgatcagctggcgttattgcaggacaaagtcgctccgtttgatggcaagctggcgaagcagcagattgaagctgcaatgggcggcttgccggtagaagcgtggtttgacgattttgaaatcaagccgctggcttctgcttctatcgcccaggttcataccgcgcgattgaaatcgaatggtaaagaggtggtgattaaagttatccgcccggatattttgccggtcattaaagcggatctgaaacttatttaccgtctggctcgctgggtgccgcgtttgctgccggatggtcgccgtctgcgcccaaccgaagtggtgcgcgagtacgaaaagaccttgattgatgaactgaatttgctgcgggaatctgccaacgccattcagcttcgacgcaattttgaagacagcccgatgctctacatcccggaagtttaccctgactattgtagtgaagggatgatggtgatggagcgtatttacggcattccggtgtctgatgttgcgacgctggagaaaaacggcaccaacatgaaattgctggcggaacgcggcgtgcaggtgttcttcactcaggtctttcgcgacagctttttccatgctgatatgcaccctggcaacatcttcgtaagctatgaacacccggaaaacccgaaatatatcggcattgattgcgggattgttggctcgctaaacaaagaagataaacgctatctggcggaaaactttatcgccttctttaatcgcgactatcgcaaagtggcagagctacacgtcgattctggttgggtgccaccagataccaacgttgaagagttcgaatttgccattcgtacggtctgtgaacctatctttgagaaaccgctggccgaaatttcgtttggacatgtactgttaaatctgtttaatacggcgcgtcgcttcaatatggaagtgcagccgcaactggtgttactccagaaaaccctgctctacgtcgaaggggtaggacgccagctttatccgcaactcgatttatggaaaacggcgaagcctttcctggagtcgtggattaaagatcaggtcggtattcctgcgctggtgagagcatttaaagaaaaagcgccgttctgggtcgaaaaaatgccagaactgcccgaactggtttacgacagtttgcgccagggcaagtatttacagcatagtgttgataagattgcccgcgagcttcagtcaaatcatgtacgtcagggacaatcgcgttattttctcggaattggcgctacgttagtattaagtggcacattcttgttggtcagccgacctgaatgggggttgatgcccggctggttaatggcaggtggtctgatcgcctggtttgtcggttggcgcaaaacacgctgattttttcatcgctcaaggcgggccgtgtaacgtataatgcggctttgtttaatcatcatctaccacagaggaacatgtatgggtggtatcagtatttggcagttattgattattgccgtcatcgttgtactgctttttggcaccaaaaagctcggctccatcggttccgatcttggtgcgtcgatcaaaggctttaaaaaagcaatgagcgatgatgaaccaaagcaggataaaaccagccaggatgctgattttactgcgaaaactatcgccgataagcaggcggatacgaatcaggaacaggctaaaacagaagacgcgaagcgccacgataaagagcaggtgtaatctgtgtttgatatcggttttagcgaactgctattggtgttcatcatcggcctcgtcgttctggggccgcaacgactgcctgtggcggtaaaaacggtagcgggctggattcgcgcgttgcgttcactggcgacaacggtgcagaacgaactgacccaggagttaaaactccaggagtttcaggacagtctgaaaaaggttgaaaaggcgagcctcactaacctgacgcccgaactgaaagcgtcgatggatgaattacgccaggctgcggagtcgatgaagcgttcctacgttgcaaacgatcctgaaaaggcgagcgatgaagcgcacaccatccataacccggtggtgaaagacaatgaaactgcgcatgaaggcgtaacgcctgctgctgcacaaacgcaggccagttcgccggaacagaagccagaaactacgccagagccggtggtaaaacctgctgcggacgctgaaccgaaaaccgctgcaccttccccttcgtcgagtgataaaccgtaaacatgtctgtagaagatactcaaccgcttatcacgcatctgattgagctgcgtaagcgtctgctgaactgcattatctcggtgatcgtgatattcctgtgtctggtctatttcgccaatgacatctatcacctggtatccgcgccattgatcaagcagttgccgcaaggttcaacgatgatcgccaccgacgtggcctcgccgttctttacgccgatcaagctgacctttatggtgtcgctgattctgtcagcgccggtgattctctatcaggtgtgggcgtttatcgccccagcgctgtataagcatgaacgtcgcctggtggtgccgctgctggtttccagctctctgctgttttatatcggcatggcgttcgcctactttgtggtctttccgctggcatttggcttccttgccaataccgcgccggaaggggtacaggtatccaccgacatcgcgagctatttaagcttcgttatggcgctgtttatggcgtttggtgtctcctttgaagtgccggtggcaattgtgctgctgtgctggatggggattacctcgccagaagacttacgcaaaaaacgcccgtatgtgctggttggtgcattcgttgtcgggatgttgctgacgccgccggatgtcttctcgcaaacgctgttggcgatccctatgtactgcctgtttgaaatcggtgtcttcttctcacgcttttacgttggtaaagggcgaaaccgggaagaggaaaacgacgctgaagcagaaagcgaaaaaactgaagaataaattcaaccgcccgtcagggcggttgtcatatggagtacaggatgtttgatatcggcgttaatttgaccagctcgcaatttgcgaaagaccgtgatgatgttgtagcgcgcgcttttgacgcgggagttaatgggctactcatcaccggtaccaatctgcgtgaaagccagcaggcgcaaaagctggcgcgtcagtattcgtcctgttggtcaacggcgggcgtacatcctcacgacagcagccagtggcaagctgtgactgaagaagcgattattgagctggccgcgcagccagaagtggtggcgattggtgaatgtggtctcgactttaaccgcaacttttcgacgccggaagagcaggaactcgcttttgttgcccagctacgcattgccgcagaattaaacatgccggtatttatgcactgtcgcgatgcccacgagcggtttatgacattgctggagccgtggctggataaactgcctggtgcggttcttcattgctttaccggcacacgcgaagagatgcaggcgtgcgtggcgcgtggaatttatatcggcattaccggttgggtttgcgatgaacgacgcgggctggagctgcgggaattgttgccgttgattccggcggagaaattgctgatcgaaactgatgcgccgtatctgctccctcgcgatctcacgccaaagccatcatcccggcgcaacgagccagcccatctgccccatattttgcaacgtattgcgcactggcgtggagaagatgccgcatggctggctgccaccacggatgccaatgtcaaaacactgtttgggattgcgttttagagtttgcggaactcggtgttcttcacactgtgcttaatctctttattaataagattcagcaatagcatggagcgagcctcgccgtctggctcggtgaaaatggcctgaaaaccttcgaatgcgccttcagtaataatcactttatcaccaggatacggcgtcgatggatcgacaatatctttcggtttatacactgataactgatgaatcaccgccgatgggactatcgctggcgacgcgccaaagcgcacgaagtggctgacaccgcgggtcgcgttgatagtcgtggtatgaatcacttccggatcgaactccacaaacaagtagttggggaacaatggctcactgactgcagtacgtttgccacgcacgattttttccagggtgatcatcggtgccaggcaattcacagcctgtctttcgaggtgttcctgggcacgttgaagttgcccgcgcttgcagtacagtaaataccaggattgcataatgactcttatccgtttaatcggggcgcaaggatagcaaaagctttacgctaagttaattatattccccggtttgcgttataccgtcagagttcacgctaatttaacaaatttacagcatcgcaaagatgaacgccgtataatgggcgcagattaagaggctacaatggacgccatgaaatataacgatttacgcgacttcttgacgctgcttgaacagcagggtgagctaaaacgtatcacgctcccggtggatccgcacctggaaatcactgaaattgctgaccgcactttgcgtgccggtgggcctgcgctgttgttcgaaaaccctaaaggctactcaatgccggtgctgtgcaacctgttcggtacgccaaagcgcgtggcgatgggcatggggcaggaagatgtttcggcgctgcgtgaagttggtaaattattggcgtttctgaaagagccggagccgccaaaaggtttccgcgacctgtttgataaactgccgcagtttaagcaagtattgaacatgccgacaaagcgactgcgtggtgcaccctgccaacaaaaaatcgtctctggcgatgacgtcgatctcaattgtattcccattatgacctgctggccggaagatgccgcgccgctgattacctgggggctgaccgtgacgcgcggcccgcataaagagcggcagaatctgggcatttatcgccagcagctgattggtaaaaacaaactgattatgcgctggctgtcgcatcgcggcggcgcgttggattatcaggagtggtgtgcggcgcatccgggcgaacgtttcccggtttctgtggcgctgggtgccgatcctgccacgattctcggtgcagtcacccccgttccggatacgctttcagagtatgcgtttgccggattgctgcgcggcaccaagaccgaagtggtgaagtgtatctccaatgaccttgaagtgcccgccagtgcggagattgtgctggaagggtatatcgaacaaggcgaaactgcgccggaagggccgtatggcgaccacaccggttactataacgaagtcgatagtttcccggtatttaccgtgacgcatattacccagcgtgaagatgcgatttatcattccacctataccgggcgtccgccagatgaacctgcggtactgggtgtagcactgaacgaagtgttcgtgccgattctgcaaaaacagttcccggaaattgtcgatttttacctgccgccggaaggctgttcttatcgtctggcggtagtgacgatcaaaaaacagtacgccggacacgcgaagcgcgtcatgatgggcgtctggtcgttcttacgccagtttatgtacactaaatttgtgatcgtttgcgatgatgacgtcaacgcacgcgactggaacgatgtgatttgggcgattaccacccgtatggacccggcgcgggatactgttctggtagaaaatacgcctattgattatctggattttgcctcgcctgtctccgggctgggttcaaaaatggggctggatgccacgaataaatggccgggggaaacccagcgtgaatggggacgtcccatcaaaaaagatccagatgttgtcgcgcatattgacgccatttgggatgaactggctatttttaacaacggtaaaagcgcctgatgcgcgtttgttttgccctatttatcgatccgacagagaaagcgcatgacaaccttaagctgtaaagtgacctcggtagaagctatcacggataccgtatatcgtgtccgcatcgtgccagacgcggccttttcttttcgtgctggtcagtatttgatggtagtgatggatgagcgcgacaaacgtccgttctcaatggcttcgacgccagatgaaaaagggtttatcgagctgcatattggcgcttctgaaatcaacctttacgcgaaagcagtcatggaccgcatcctcaaagatcatcaaatcgtggtcgatattccccacggagaagcgtggctgcgcgatgatgaagagcgtccgatgattttgattgcgggcggcaccgggttctcttatgcccgctcgattttgctgacagcgttggcgcgtaacccaaaccgtgatatcaccatttactggggcgggcgtgaagagcagcatctgtatgatctctgcgagcttgaggcgctttcgttgaagcatcctggtctacaagtggtgccggtggttgaacaaccggaagcgggctggcgtgggcgtactggcaccgtgttaacggcggtattgcaggatcatggtacgctggcagagcatgatatctatattgccggacgttttgagatggcgaaaattgcccgtgacctgttttgcagcgagcgtaatgcgcgggaagatcgcctgtttggcgatgcgtttgcatttatctgagatataaaaaacccgcccctgacaggcgggaagaacggcaactaaaactttatacagtggcatttagatctatgtcgcatccggcaattggtgcacgatgcctgatgcgacgctggcgcgtcttatcaggcctacattggtgccggatcggtagaccggataaggcgttcacgccgtatccggcatacagtgcccgatgcgacgctgccgcgtcttatcgggcctacaaaagttctgaaccgtagaccggataaggcgttcacgccgcatccggcaagtggttaaacccgctcaaacaccgttgcaatgccctgacccagaccgatacacatcgtcgccagaccaaactggacgtctttgtgttccatcagattcagcagcgtggtgctgatacgcgcaccggaacaacccagcggatgacccagcgcgatcgcgccaccgttgaggttgatcttctcgtcaatctgctctattagcccgagatctttaatacacggcaggatctgcgcggcaaaggcttcgttcatctcgaatacgccgatatcgctggcagaaagccccgcttttttcagcgccagcttcgaggccggaaccggaccataacccataatagatgggtcacaacccacaaccgccatcgaacgcacgcgggcgcgcggcttaagacctaattcacgggcgcggctttcactcatcaccagcatggcagctgcgccatcggaaagcgcagaagatgtacccgccgttaccgtaccgctgacgggatcaaacgccggacgcagtgtggcgagggcttccacggtggtttccgggcgaatcacttcgtcgtaattaaactgcttcaatacgccgtcggcatcgtgaccaccggtcgggatgatttcatttttaaatgcgcctgactgcgtggcggcccacgcgcgggcgtgtgaccgcgcggcaaaggcatcctgcatttcacggctgataccatgcatacgcgccagcatttctgccgttaagcccatcatgcccgccgctttggcgacattacggctaaggccggggtgaaaatcgacgccgtgactcattggcacatggcccatatgctccacgccgccaaccagacatgcctgcgcatcgccggtcatgatcattcgtgctgcgtcatgcagtgcctgcatggatgaaccacacaagcgattaacggtaaccgccgggacagagtgcggcacttcagccaacagtgccgcgttacgggcgatgttaaaaccctgctccagtgtttgctgcacacaaccccagtaaatatcgtcgagggccgctgcttccagcgccgggttacgcgccagcaggctacgcattaaatgagcggagagatcttccgcacgcacgttacgaaaagcaccgcccttcgaacggcccatcggggtgcgaattgcatcgacaatgacaacctgttccattgtgactccttaagccgttttcaggtcgccaaccggacgggctggctcaaccgggggatagtacggttcgttatgacgtgctttattacgcagaccttccggtacttcatacagcgggccgaggtgctgatattgctgtgccatatcgaggtattttgcgctgccgagggtgtccagccagcggaacgcgccgccgtggaacggagggaagcccaggccgtagaccagcgccatatccgcttctgccggagtggcgataatgccctcttccagacagcggaccacttcgttgaccatcgggatcatcatgcgggcgataatctcttcctcgctgaaatcgcgcttcggctggctcacttttgccagcaggtcgtcaacgacgacatcttcttctttcttcggcttacctttgctgtcttctttataacgccagaaaccgaggccgttcttctgaccaaagcggttggcatcaaacagcgcgtcgatggcatcgcgataatctttctgcatccgctgcgggaagcctgctgccatgacagcctgagcgtgatgcgcggtgtcaatgcccacaacatccagcagatatgccggacccatcggccagccaaactgtttttccatcactttgtcgatcttgcggaaacccgcgccgtcgcgcagcaactggctgaaaccggcgaaataggggaacagcacacggttgacgaagaagccggggcagtcgttgaccacaatcggcgtcttgcccatcttgctcgcccaggcgacgactttcgcgatggtttcgtcggagcttttctcgccgcgaataatttccaccaacggcatccggtgcaccgggttaaagaagtgcatcccgcagaagttttccggacgttccagcgcgttggccagttcgctgataggaatggttgaagtgttagacgccagcacggtatccgggcgtactttctgctcggtttctgccagcacggcttttttcactttcgggttttcaacaaccgcttctaccacaacatccacgcggtcaaacccggcgtagtcgagcgttgggtgaattgtggagatcacgccagccagtttcagaccatcgatcttgccgcgctcaagctgcttgttcagcagtttcgcggcttcggtcatgccgagggttaacgacttgtcgttgatatctttcatgacaaccggcacgcctttccacgcagactggtaggcgatgccgccgcccataatgcctgcgcccagcacagcggcctgtttcggggtttcaacatctttggtgagtttcttcgctttaccttttacatattgatcgttaaggaaaatgccgaccagtgcgcgggcttcgttggtatgcgccagcgggacaaaacttttgttttccaggtttaaggcttcttcacgaccaaaacgggccgcagcttcaatggtttttactgcggtgatgggggccggataatgtttccccgccgtttgcgcgaccatccctttagcgatggtgaagctcatggcggcttcaatcttgctcagttttagcggttccagcttcggctgacgttttgctttccagtcgaggtcgccgttaatggcctggcgtaaaatcgctatcgccccttcaaccagtttttctgctttgactacgccatccaccagaccgattttcagcgcctgatccgcgccgacatctttaccggcggcaatgatttccagcgcactgtcagcgcccagcatacgtggcatacgtacagaaccgccaaagcccggcatgatgcccaatttggtttccggcagaccgatgcgcagatccggcgtcgccagacgataatcggtcgccagcacgcattcgcagccaccgcccagcgcatagccgttgacggcagcaatggtcggcaccgggagatcttccaggcgattaaacacgctattggcaaagtgcagccactgacttaactgttcttcaggaacgaggaacagggacaaaaattcggtgatatcagcaccgacgataaaggctgctttgttcgaacgcagcagcagcccttttagatctgattgctgttccagcacgccgatggcctcgccgaggctggcgacggtggcagtgtcgagtttattaactgaacctggggcatcaaataccagttcggcaatgccatcttccagccagtcaaggtacagggtgtcgcctttgtaaagcatgtcagtctcctgaatccgcaaggtgatctggtcgtaccagatgcatcgaagtgtgtattttatgttaaaaatatacaaataaaagattaaagaaatgccgatctgatcacgctcggcagaaatcacgctctggatgaacgatgtgctaagatgcggagacttaaggtcaaaaaaacagaagggtaaaaaatggaatcactggcctcgctctataaaaatcatatagctaccttacaggaacggactcgcgatgcgctggcgcgcttcaagctggatgcgttacttattcactccggcgaactgttcaacgtttttctcgacgatcatccctatccgtttaaagtgaacccgcaattcaaagcgtgggtgccagtaactcaggtgccaaactgctggctgctggtggatggcgtgaataagccgaaactgtggttctatctaccggttgattactggcacaacgtcgaaccgctgccgaactccttctggactgaagatgtagaagtgatcgcgctgccgaaagccgatggcattggtagtctgttgcctgctgcgcgcggcaatatcggttatatcggtccggtgccagaacgtgcgctgcaactgggtattgaggccagcaatatcaacccgaaaggggtgatcgactacctgcattactatcgctccttcaaaaccgagtacgaactggcctgtatgcgtgaagcgcagaaaatggcggtcaacggtcatcgcgcggcagaagaagcgttccgttctggcatgagcgagttcgatatcaacattgcctatctgaccgcgaccggtcatcgtgataccgacgtaccttatagcaacattgtggcgcttaacgaacacgctgcggtgttgcattacaccaaactggaccaccaggcaccggaagagatgcgcagcttcctgctggatgccggggccgaatataacggctatgcggctgacctgacccgtacctggtcggcaaaaagcgacaacgactacgcacagctagtgaaagacgtaaatgatgaacaactggcgctgatcgccaccatgaaagctggcgtcagctatgtggattaccacatccagttccatcagcgcatcgccaaactgctgcgtaaacatcaaatcatcaccgatatgagtgaagaagcgatggtcgaaaacgatctcaccggaccgtttatgccgcacggtatcggccatccgctgggcctgcaggtgcatgacgtagccggttttatgcaggatgatagcggtacgcacctcgcggcaccggcaagatatccgtacctgcgctgcacccgtattctccagccgggcatggtgttaaccatcgaaccgggtatctacttcatcgaatcgcttctggcaccgtggcgtgaagggcagttcagcaaacacttcaactggcagaaaattgaagcgctgaaaccgttcggcggcattcgtatcgaagacaacgtggtgattcacgaaaacaacgtggaaaacatgacccgggatctgaaactggcgtgatggaaagctggttaattcctgcggcaccggtcacggtcgttgaagagatcaaaaagagccgcttcattacgctgttggcgcataccgatggcgttgaggcggcaaaagcgtttgttgaatcggtgcgggcagaacaccccgatgcccgccaccattgcgtggcgtgggtggcgggtgcgccggatgattctcaacagctgggtttctctgacgacggggagccggcgggaacggcaggtaaaccgatgctcgcccaactaatgggcagcggcgtcggggaaattaccgctgtggtggtgcgctactacggcggcatattgcttggcaccggtgggttagtgaaagcgtatggcggcggcgtgaatcaggcgctgcgccagctaacgacccaacgcaagacaccattaaccgaatatactttgcaatgtgaatatagtcagttaaccggcattgaagcgttgctggggcagtgtgacggcaaaattatcaacagtgattatcaggcattcgttctgctgcgggtggcgcttccggcggcgaaagtggctgaattttccgcaaagctggcggattttagccgtggttcattgcaattgttagcgattgaagaataatccccacttcgttttgcagaactaaggaagcggcagagatgcattttcgcgccattacccgaatcgttggactactggtcatcttattttcagggaccatgattatccctgggctggtagcactcatctaccgggatggagcgggacgcgcttttacccagaccttttttgtcgccctcgccattggctctatgctttggtggccgaaccgcaaagagaagggcgaactgaaatcccgtgaggggtttctgatagtggtgctgttctggaccgtgctgggtagcgtcggtgcgctcccttttatcttctcggaaagcccgaacctcacgattaccgatgcgttttttgaatctttctctggcctgaccaccacgggggccactacgctggtggggctggattcgctccctcatgccatcctcttttatcgccagatgctgcaatggtttggcggtatggggatcatcgtgctggcggttgcgatactgcctatcctcggcgtgggtgggatgcagctctatcgcgcagaaatgcccggcccgctgaaagataacaaaatgcgcccgcgaattgcggaaacggcgaaaaccctgtggttgatttatgtcttgctgaccgtcgcctgtgcgctggcgttgtggtttgctggaatggatgcctttgatgccatcggccatagctttgcgaccatcgctattggcggcttctcgacacatgatgccagtatcggttatttcgacagcccgactattaacactatcattgctatcttcctgctgatctctggctgtaactacggtctgcacttttcactgttaagtgggcgtagtctgaaggtttattggcgcgatccggaatttcgcatgtttatcggcgtacagttttcactggtggttatttgtacactcgtactgtggtttcataatgtctacagttcggcgctgatgacaattaaccaggcgtttttccaggtggtgtcgatggcgacaaccgccgggtttacaactgacagcattgcccgctggccgctctttttgccggtactgcttttatgttcagcttttatcggcggttgcgccgggtcaacgggcggtggcctgaaagtgatccgcatcctgctgctgtttaagcaggggaaccgtgagctgaaacgactggtgcatccgaacgccgtctatagcattaagctggggaatcgcgcactgccggaacgtatcctcgaagccgtttggggatttttctccgcctatgcattggtgtttattgtcagtatgctggcgattatcgccacgggcgtggatgacttttctgcctttgcctcggttgttgcaacattgaataacctggggccagggcttggcgtggttgctgataactttaccagtatgaacccggtggctaaatggatcctgattgccaacatgctgtttggtcgtctcgaggtctttacattgctggtgctctttaccccgactttctggcgtgaatgatggagtaatacgtgaaaacattaattcttttctcaacaagggacggacaaacgcgcgagattgcctcctacctggcttcggaactgaaagaactggggatccaggcggatgtcgccaatgtgcaccgcattgaagaaccacaatgggaaaactatgaccgtgtggttattggcgcttctattcgctatggtcactaccattctgcgttccaggaatttgtcaaaaagcatgcgacgcggttgaattcgatgccgagtgccttttactccgtaaatctggtggcgcgtaaaccggagaagcgtactccacagaccaacagctacgcgcggaagtttctgatgaactcgcaatggcgtcccgatcgctgtgccgtcattgccggggcgctgcgttacccacgttatcgctggtacgaccgttttatgatcaagctgattatgaagatgtcaggcggtgaaacggatacgcgcaaagaagttgtctataccgattgggagcaggtggcgaatttcgcccgagaaatcgcccatttaaccgacaaaccgacgctgaaataagcataaagaataaaaaatgcgcggtcagaaaattattttaaatttcctcttgtcaggccggaataactccctataatgcgccaccactgacacggaacaacggcaaacacgccgccgggtcagcgggattctcctgagaattccggcagagaaagcaaaaataaatgcttgactctgtagcgggaaagcgtattatgcacaccccgcgccgctgagaaaaagcgaagcggcactgctctttaacaatttatcagacaatctgtgtgggcactcgaagatacggattcttgacgtcgcaagacgaaaaatgaataccaagtctctgagtgaacacgtaattcattacgaagtttaattcacgagcatcaaacttttaaattgaagagtttgatcatggctcagattgaacgctggcggcaggcctaacacatgcaagtcgaacggtaacagaaagcagcttgctgctttgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgtactttgaagtgctcacacagattgtctgatgaaaatgagcagtaaaacctctacaggcttgtagctcaggtggttagagcgcacccctgataagggtgaggtcggtggttcaagtccactcaggcctaccaaatttgcaccgcaaatttgaagaggttttaactacatgttatggggctatagctcagctgggagagcgcctgctttgcacgcaggaggtctgcggttcgatcccgcatagctccaccatctctgtagtgattaaataaaaaatacttcagagtgtacctgcaaaggttcactgcgaagttttgctctttaaaaatctggatcaagctgaaaattgaaacactgaacaatgaaagttgttcgtgagtctctcaaattttcgcaacacgatgatgaatcgcaagaaacatcttcgggttgtgaggttaagcgactaagcgtacacggtggatgccctggcagtcagaggcgatgaaggacgtgctaatctgcgataagcgtcggtgaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgcgcgatacagggtgacagccccgtacacaaaaatgcacatactgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcctcttaatggggtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacactatgtgttgttgggtaggggagcgttctgtaagcctgtgaaggtggcctgtgagggttgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaaccaaggctgaggcgtgatgacgaggcactacggtgctgaagcgacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagcggcaacgcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttggcccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagacttagagtctcctgaaggaacgttgaagacgacgacgttgataggccgggtgtgtaagcgcagcgatgcgttgagctaaccggtactaatgaaccgtgaggcttaaccttacaacgccgaagatgttttggcggatgagagaaagattttcagcctgatacagattaaatcagaacgcagaagcggtctgataaacagaatttgcctggcggccttagcgcggtggtcccacctgaccccatgccgaactcagaagtgaaacgccgtagcgccgatggtagtgtggggtctccccatgcgagagtagggaactgccaggcatcaaattaagcagaaggccatccgtcaggatggcctttttgcattggcgcagaaaaaatgccggatgcgacgctggcgcgtttgctccagcctactcttgcttatccgtcctgcttttgcatccactccaccacaaaatcagccagcccctcaacatcattaatatccagtaacgcgacatcaagattaagcggcacatcactggctacagcaataacatgcctgtctatcactaattcttccggtcgatgtccggctccatcgcgaaacagcacaatctttgcgatctcttcatgcttaaacccttcgaccagaatcaaatccagctttgaggtatccattcgacttgcgagaaaatgtagatccagctcttcttcgtctggtgtttccgtcatcaaggcccatcgctgttggctggcaacgatggtttgcgccgcgccagccttgcgcagctcatagctatctttgcccggtttatcaacatccatatcatggtgcgtatgcttaatcagccccggacggatccctctggcgcataatgccgggatcaattttttcagcagcgttgtttttccggtgccactccatgcagcaaaggcgagtaacggtatcatcgtttttcctgccatcgggcaagctcctctggcgtattcacgtttataaatgcctctttacgatcgctgaaatcaaccgcatgaccgccagccagacgcataaatgccataacccggcgttctcctgcttgcagatattccagtaataaaggctcaattgcgcggtttaccagagcaatagtcgggtgatcgcgttcaccgtcgtggacccacacgacaggcgcatctttgcgctgatgagtaagccgggcggctaaatcatggggaatgtaaggcgtatcgcacgggcaaaacaaaaaccactcacccgcttcctgctgcattactgaaagcattcctgccagaggaccagggtaatccgccagtgaatcttcaatcactttcagaccgcttacctgatagatttcctgatgacgattagcattaaccacgacgtgagaaagctgcgtcataagcgcgtcagcgacatgctgccataatggtttgccgtttaattcaagcaatcctttatctacgccgcccattcgtctggctttaccgcccgccagcacaacgcctgttatcgtcgtcatcagattcaccgatatcgcctcttttattgtgggattgaccctgctaacgtgtctgtctcaagagtaaggagcattactatgaaatgtaaacgtctgaatgaagttattgaactcctccagccagcctggcaaaaagagccagactttaacctgctgcaatttttgcagaaactggcgaaagagtcaggttttgacggcgaactggcggatttgacggatgacattctgatctatcacctgaaaatgcgtgattccgcgaaagatgcggtgatcccgggtttgcagaaagattatgaagaagatttcaaaacggcgctattacgcgcacgtggtgtaattaaagagtaaaagcttgtaagcggcgcaaccaaaatcatcgtgaaatgatatccttcatcattcgtaatgttttccggatgatgggatgaacaacagcgcttttactttccagacactacacccggataccatcatggacgctctgtttgagcatgggattcgggtggattccggtcttaccccgcttaacagctatgaaaaccgtgtctatcaatttcaggacgaagatcgtcgacgttttgtcgtcaaattttatcgccctgaacgttggacagccgatcaaatcctcgaagaacatcaatttgcgttgcagctggttaacgatgaagttccggtcgcagcacctgtggcctttaatggtcagactttattgaaccatcagggattttatttcgctgtttttccaagcgtcggtggtcgccagttcgaagctgataatatcgatcagatggaagcggttgggcgttatttagggcgtatgcaccagacggggcgcaaacagctttttatccatcgcccgaccatcggtttgaatgaatatctcattgagccacgcaagctgtttgaggacgctacactaataccttccgggttgaaagcggcattcctgaaagcgacagatgagctgattgccgccgttacagcacactggcgggaagatttcaccgttctgcggctacatggagactgccacgccgggaatattctctggcgcgatggtccaatgtttgttgatctggatgatgcacgtaatggtccagccgttcaggatttgtggatgttgctcaatggtgataaagccgagcagcggatgcaactggaaactattattgaggcttatgaagaatttagcgagttcgacaccgctgaaatcggactgattgaacctttacgcgccatgcgtttggtttattatcttgcctggctaatgcggcgttgggctgatcccgcgttcccgaaaaatttcccgtggttaaccggggaagattactggctacgacagacggcgacttttatagaacaggcaaaagttctacaagaaccccctttgcaattaacacctatgtattaatcggagagagtagatcatgaaaaagatttggctggcgctggctggtttagttttagcgtttagcgcatcggcggcgcagtatgaagatggtaaacagtacactaccctggaaaaaccagttgctggcgcgccgcaagtgctggagtttttctctttcttctgcccgcactgctatcagtttgaagaagttctgcatatttctgataacgtgaagaaaaaactgccggaaggcgtgaagatgactaaataccacgtcaacttcatggggggggacctgggcaaagagctgactcaggcatgggctgtggcgatggcgctgggcgtggaagacaaagtcacagttccgctgtttgaaggcgtacaaaaaacccagaccattcgttcagcatctgatatccgcgatgtatttatcaacgcaggtattaaaggtgaagagtacgacgcggcgtggaacagcttcgtggtgaaatctctggtcgctcagcaggaaaaagctgcagctgacgtgcaattgcgtggtgttccggcgatgtttgttaacggtaaatatcagctgaatccgcagggtatggataccagcaatatggatgtttttgttcagcagtatgctgatactgtgaaatatctgtccgagaaaaaataattcaatgtaaattacataaagcccgtgaatattcacgggctttttttattatttaataaatataaatacattctgataatgcgtcctgctgctggacattatttcagcataagtggatattcaaagttttgctgttttatcagggaatatttatatgatacgtaagtcagctacaggtgccattgttgcgttagccgtaatctggggtggtggcacatggtacacaggtacgcaaattcagcctggtgtcgaaaagtttattaaaggttttaacgatgctaaaaagaaaggtgaacatgcctacgatatgacgttaagttataaaaattttgacaaaggcttttttaattcccgttttcaaatgcaaatgacatttgataacggtgcacccgatctcaatatcaagccaggccagaaaattgtatttgatgtggatgttgagcacggtccgttgcccatcacaatgttaatgcatggtaatgtcatcccagcactggcagcggcaaaagtgaacttagtgaataatgagctgacacaaccgctatttatcgccgcgaaaaataaatcgcccgtggaagcgacattgcgattcgcgtttggtggcccattctccacgacattagatgttgcccctgcagagtatggaaagttttcttttggtgaaggccagtttacttttaatggtgatgatagttcattgtctaacctggatattgaaggcaaagtcgaagatattgttctgcaattttcaccaatgaacaaagtaacggcgaaaagttttaccattgattctctgacacgattagaagaaaagaaatttccggttggtgaaagcgagtcgaaatttaatcaggttaatattatcaaccagggggaagtcgttgcccaaatcgatgctttcgttgcaaaaaccaggctggatcgcgttaaagacaaagattatatcaatgtcaatctgacctacgaacttgataagttaacaaaagggaatcagcaactcggtagtggtgagtggtcattgattgctgaatctattgatccctcagcggtgcgccaatttatcatccagtataacattgcgatgcagaagcagcttgctgcacaccctgagttagcaaacgatgaagttgctctgcaagaagtgaatgctgcattgttcaaagagtatttaccgttattacaaaaaagtgagccgaccattaaacaaccagtaagatggaagaacgcactcggcgaactaaatgccaatctggatatcagtattgccgaccccgccaaatcttcatcatccacaaacaaagatattaaatcgctcaattttgatatgaagttaccgcttaatgtcgccacagaaaccgcaaaacagcttaatttatctgaagggatggatgcggaaaaagcgcaaaagcgggctgataaacaaatcagcgggatgatgacattaggtcagatgttgcagttaatcacgattgacaacaataccgcctcgctgcaactgcgttatacaccgggtaaagttttttttaacggtcaggagatgagcgaagaagaatttatgtctcgtgccggacgttttgttcattaaaatactcactcgcctctgctcattcagaggcgagtaaaacttacttttcctgccgctgtgatgacatcaacgatgtcagaagccggtctttttcctgccacaatgagttcagccattgctgaaaatggcgcttaaagcttttgtcattgatgtagtcgccatgtaactcatcggcaataggctgtaaatccacatgtacgacaattcgcgtcagtttaccgcttaacatatcgaagaacggctgacggttattgtccggataacacagcgtaacattaagcagtttatcgaattgtttacccagtacatttagcgccatcgcaatgcctgccgcctttggtggcaacaagttttgaaaagtggagtgggtttgctgatgtttttcttgcgtgaaacgggagccttcaacgaaattgacaatagtggtgggatgcaggcgaaacttttcacaagaacgccgagtggtttcaacatctttaccacgtcgctccggatgacgtaataaataagcgcgggaataacgcttcataaacggcatatccagcgcccagcacgccaggccaagaaaaggcacccaggccagctgctgcttgaggaaatatttattcatcggaatgtgcttacgaaacagcacgcacagtacgacaatatctgcccaactacggtggttacaaataagcagataccagttcttcttacttaacccttccagcccgtgaacttcccattgcaggtgtgggttcagatgcagtaataccgccagaccttcacaccagcaatacatcataaaatcacaaaaacgcgaaacctttcgccaaatgactggcacaggtagcaatagttttacaatcccggcaatgatgatcgggacggaacaaaaaatagtgacccaaatggtcaatacgatactcagcaaaagggttatcgcagcgagtattctcgtcataatgaatttattcaaaaggttagccatagacagtgcgctaaagaagcgcaaggcgcagattttagcagaaaacgacccaaataacggatgatccttaaggagaaaaataattcatatctatccacattagaaaaaatcccatcatctcaattattagggatggctttatttttaactgcatgaaaaacaaagataaacatcatgctgtaaaaagcatgataataaattaaaagcgatgtaaataatttatgcacaaagttatccacatgacgatttgcgagcgatccagaagatctacaaaagattttcacgaaaagcggtgaaaaactcatgttttcatcctgtctgtggcatcctttacccataatctgataaacaggcacggacattatggttcagatcccccaaaatccacttatccttgtagatggttcatcttacctttatcgcgcatatcacgcgtttcccccgctgactaacagcgcaggcgagccgaccggtgcgatgtatggtgtcctcaacatgctgcgcagtctgatcatgcaatataaaccgacgcatgcagcggtggtctttgacgccaagggaaaaacctttcgtgatgaactgtttgaacattacaaatcacatcgcccgccaatgccggacgatctgcgagcacaaatcgaacctctgcacgcgatggttaaagcgatgggactgccgctgctggcggtttctggcgtagaagcggacgacgttatcggtactctggcgcgcgaagccgaaaaagccgggcgtccggtgctgatcagcactggcgataaagatatggcgcagctggtgacgccaaatattacgcttatcaataccatgacgaataccatcctcggaccggaagaggtggtgaataagtacggcgtgccgccagaactgatcatcgatttcctggcgctgatgggtgactcctctgataacattcctggcgtaccgggcgtcggtgaaaaaaccgcgcaggcattgctgcaaggtcttggcgggctggatacgctgtatgccgagccagaaaaaattgctgggttgagcttccgtggcgcgaaaacaatggcagcgaagctcgagcaaaacaaagaagttgcttatctctcataccagctggcgacgattaaaaccgacgttgaactggagctgacctgtgaacaactggaagtgcagccaccggcggcggaagagttgttagggctgttcaaaaagtatgagttcaaacgctggactgctgatgtcgaagcgggcaaatggctacaggctaaaggggcgaaacccgcagccaggccgcaggaaaccagtgttgcagacgaagcgccagaagtgacggcaacggtgatttcttatgacaactacgtcactatccttgatgaagaaacactgaaagagtggattgcgaagctggaaaaagcgccggtatttgcatttgataccgaaacagacagccttgataacatctctgctaacctggtcgggctttcttttgctatcgagccaggcgtagcggcatatattccggttgctcatgattatcttgatgcgcccgatcaaatctctcgcgagcgtgcactcgagttgctaaaaccgctgctggaagatgaaaaggcgctgaaggtcgggcaaaacctgaaatacgatcgcggtattctggcgaactacggcattgaactacgtgggattgcgtttgataccatgctggagtcctacattctcaatagcgttgccggacgtcacgatatggacagcctcgcggaacgttggttgaagcacaaaaccatcacttttgaagagattgcgggtaaaggcaaaaatcaactgacctttaaccagattgccctcgaagaggccggacgttacgccgccgaagatgcagatgtcaccttgcagttgcatctgaaaatgtggccggatctgcaaaaacacaaagggccgttgaacgtcttcgagaatatcgaaatgccgctggtgccggtgctttcacgcattgaacgtaacggtgtgaagatcgatccgaaagtgctgcacaatcattctgaagagctcacccttcgtctggctgagctggaaaagaaagcgcatgaaattgcaggtgaggaatttaacctttcttccaccaagcagttacaaaccattctctttgaaaaacagggcattaaaccgctgaagaaaacgccgggtggcgcgccgtcaacgtcggaagaggtactggaagaactggcgctggactatccgttgccaaaagtgattctggagtatcgtggtctggcgaagctgaaatcgacctacaccgacaagctgccgttgatgatcaacccgaaaaccgggcgtgtacatacctcttatcaccaggcagtaaccgcaacgggacgtttatcgtcaaccgatcctaacctgcaaaacattccggtgcgtaacgaagaaggtcgccgtatccgccaggcgtttattgcgccagaggattatgtgattgtctcagcggactactcgcagattgaactgcgcattatggcgcatctctcgcgtgacaaaggcttgctgaccgcattcgccgaaggaaaagatatccaccgtgcaacggcggcagaagtgtttggtttgccactggaaaccgtcaccagcgagcaacgtcgtagcgcgaaagcgatcaactttggtctgatttatggcatgagtgctttcggtctggcgcggcaattgaacattccgcgtaaagaagcgcagaagtacatggacctttacttcgaacgctaccctggcgtgctggagtatatggaacgcacccgtgctcaggcgaaagagcagggctacgttgaaacgctggacggacgccgtctgtatctgccggatatcaaatccagcaatggtgctcgtcgtgcagcggctgaacgtgcagccattaacgcgccaatgcagggaaccgccgccgacattatcaaacgggcgatgattgccgttgatgcgtggctacaggctgagcaaccgcgtgtgcgtatgatcatgcaggtacacgatgaactggtatttgaagtccataaagatgatgtcgatgccgtcgcgaagcagattcatcaactgatggaaaactgtacccgtctggatgtgccgttgctggtggaagtggggcgtggcgaaaactgggatcaggcgcactaagattcgcctgaacatgcccttttttcgtaagtaagcaacataagctgtcacgttttgtgatggctattagaaattcctatgcaacaactgaaaaaaaattacaaaaaatgctttctgaactgaacaaaaaagagtaaagttagtcgcgtagggtacagaggtaagatgttctatctttcagaccttttacttcacgtaatcggatttggctgaatattttagccgccccagtcagtaatgactggggcgttttttattgggcgaaagaaaagatccgtaatgcctgatacgccatgtttatcaggccaacggtagaattgtaatctattgaatttacgggccggatacgccacatccggcacaagcattaaggcaagaaaattattcgccgtcctgcgtttcttctacaggctgcatctcgctaaaccaggtatccagtttctgccgcagcttgtccacgccttgtttcttcagcgaagaaaacgtttcaacctgcacatcaccgttaaacgccagcaccgcttcacgcaccatattcaattgcgctttacgtgcgccgcttgccagtttgtccgctttggtcagcagtaccagcacggcgatattgctgtctaccgcccactcaatcatctgctgatccaaatctttcagcggatggcgaatatccattagcaccaccagaccttgcaggctctgacgtttttcgaggtactcgccgagcgcgcgctgccatttgcgcttcatctcttccgggacttccgcataaccgtacccaggcaagtcaaccagacgcttgccgtcagccacttcaaacaggttgataagctgggtgcgccccggggtttttgaggtacgagccaggcttttctggttagtcagcgtgttcagcgcgctggatttacctgcgttggaacggcctgcaaaagccacttcaattccggtatcggaaggtaggtggcgaatatcaggcgcactcatcacaaaatgcgtctgttgataattcaaattagtcaaagcggtcgtctccatcagtcaaagctttgcggcgattatacctgaaccataataaaaggcggatttttcggcgtgagcgttgtaagtaaaagccatatgctttgtgagacattgccgatagtctttatgcgaaatagcagagaaaattctgcgacgcatgtcaaataagctatataaatcagtgaattgcttttatataaaactctgaaaatgtgcaaatactgatggcggttgattgtttatttaaagcaaaggcgtaaagtagcacccatagagcgaggacgctaacaggaacaatgactcaggatgagggtcaggagcgccaggaggcgaagacagaggattgtcaggaagataaacgtccggagacgtaattaaatggaaatggaatcaacacggattgttccggctaatggaaaaacagggtgtgttggcggcctgcaaggattgtaagacccgttaagggttatgagtcaggaaaaaaggcgacagagtaatctgtcgccttttttctttgcttgctttctgttagattccgccgcaaatctatactgaataaaacggctaaaagacgaaccattatgaaaccatcatcttcaaactcacgcagcaaaggtcatgcaaaagcgcgtcgaaaaacacgcgaggagctggatcaggaagctcgtgaccgtaagcgtcagaaaaaacgtcgtggtcatgcgccgggcagccgcgcagcgggcggtaacaccacgtcaggcagcaaaggccagaacgcaccaaaagatccacgtattggcagtaaaacccctattccattgggcgtggctgaaaaagtcaccaaacagcacaaaccgaagagtgagaaacctatgctttcaccgcaggcggagttggagttactggaaacggatgagcgtctggatgcgctgctggaacgtctggaagcaggcgaaaccctgagcgccgaagagcaatcctgggtggatgtcaaactggatcgtattgatgagttgatgcagaaactcggcctctcttatgacgatgacgaagaagaggaagaagacgagaagcaagaagacatgatgcgtctgctgcggggcaactaacggattgccgccgtgggccttcccgttctgctgataacccttccggttatatgttatctggtgtggttattcgttaaactacagcggttgtcgcggcgacaaaagtggctgcgcaaccggctgatgactcgaaacgggcatccgccggtacgccgtagccgccagagacgccatcggaaggagtgagcatgtctgtacagcaaatcgactgggatctggccctgatccagaaatataactattccgggccacgatacacctcgtacccgaccgcgctggagttttcagaagacttcggcgaacaggcgtttttacaagccgtggcgcgctatcctgagcgtccattatctctctacgtacatattccgttctgccataagctttgttacttctgcggttgcaataagattgttactcgccagcagcacaaggccgatcagtatctggacgcgctggagcaagaaatcgtccatcgtgcaccgctgttcgccgggcgtcacgtcagccaattgcactggggcggcggaacgccgacgtatctgaataaagcgcaaatcagccgtctgatgaagctgctgcgcgaaaacttccagttcaatgccgatgcggagatctcgatcgaagtcgatccgcgggaaatcgaactggatgtactcgatcatttacgcgccgaaggctttaatcggctgagcatgggcgtgcaggacttcaacaaagaagtgcaacgtctggttaaccgcgagcaggatgaagagttcatctttgcactgcttaaccatgcgcgtgagattggctttacctccaccaacatcgacctgatttacggcctgccgaaacagacgccggagagtttcgcctttaccctgaaacgcgtggcggagctgaaccccgatcgtctgagcgtctttaactacgcgcatttgccgaccatttttgctgctcagcgcaaaatcaaagacgctgacctgccgagtccgcagcaaaaactcgatatcctgcaggaaaccatcgccttcctgacacaatcgggctatcagtttatcggtatggatcactttgcccgtccggatgacgagctggcggtggcccagcgtgaaggcgtgctgcatcgtaacttccagggctacaccactcagggcgataccgatctgctggggatgggcgtttccgccatcagcatgattggcgactgctacgcgcagaaccagaaagagttgaagcagtactatcagcaagtggatgaacaaggcaatgcgctgtggcgtggtattgcgctaacgcgtgatgactgtattcgccgcgatgtgattaagtcgctcatctgcaacttccgtctggattacgcccctattgagcaacagtgggatttgctcttcgctgattactttgcggaagatctcaagttgctcgccccgttagcaaaagatgggctggtggatgtggatgagaagggaatacaggtgacggcgaaaggtcgcttgctgatccgcaacatttgcatgtgctttgatacctatctgcgccagaaagcgcggatgcagcagttctctcgggtgatttaaattgtgaatggcgcttcgtttacaaagtagaaaacgaaagcgccatcaatgtgctgagaacaagattgcctgatgcgctacgcttatcaggcctgcaaaatctgttgaaattattgcttttgtaggccggataaggcgtttacgccgcatccggcaatcaacgcctgatgcgacgctggttgcgtcttatcaggcctacgactttctccgcatccggcgtaaacaacgagcttcagctaaacagaccaatcatcgcggcacacagcacggcagcaacagcagtttgcggtgtgtggctgtcaactgcgccactcgataccagattaattattgattccagcataatgactctccccgttttccgggcaagatcatactgaacttatcggaacagtaaagcgcaaaataccagcaatttgcgctcaataatcaatctttacacacaagccgtgaatcactccatccccagctcttttaacttacgcgtcagggtgttgcggccccagccaagtagccgcgccgcttcctgtttatgcccctgcgtatgtcgcagcgcggtggtcagtaacgtccgttccagctctggctgtgcttcggaaagcaggttttgatgaccggaacgcagcgctctgtctgcccactgtgctaacagcgttgcccaactgtccggctgcatgtgcgaagggctttctgctacggtggattcaaacagttcgccaggcaaatcctgaatcaacacttcctgcccggcggccatcaccgttagccagcgacaggtgttttccagctggcgcacgttgcctggccacgccagacgcgtcagcgcggcttcggtttccggatgcagcaacttcgcttctacgcccagctctcgcgcggcaacctgtaaaaaatggcgcgccagacggggaatatcttcccgacgttcgcgcagcggcggcagatgaacgcggatgacgttcaggcggtggaacagatcctcacggaacttgccttcctgcacccgctgttcaagattctggtgagtggcagcgataatccgcacatctactttcaccggcgcatagccgccaacgcgataaaactgaccgtctgccagcacgcgcagcaaacgcgtctgcacatccagcggcatatcgccaatttcatcgagaaataatgtaccgccatcagcctgttcaaaacgcccctgacgaatggtattcgcgccggtaaatgcgcctttctcgtgaccaaacagttctgattcgatcaaatccttcgggatagccgccatattgagcgcgataaacggcgctttggctcgcgggctgtggcgatgcagggcatgagcgaccagttctttaccagtgccggattcgccgttgatcagcacgctaatggaagaacgcgaaagccgaccgataatacggaacacgtcctgcatggctggcgcttcgccgatgatatcggtcgttgggccgttaagctgaacattacgcggctgctgctgttcctgataatgactgatggcgcgctcaaccagcgccacggcttcgtcgatatcaaacggtttgggcagataatcaaacgccccttgttgataggcgctgacggcagcatccagatcggaatgtgcggtcataatgatgaccggaagcatcggatggcgctgtttaatctgcttgagcagcgccagcccgtccattcccggcatacggatatctgaaagcagcacatccggcgttttgctcgccagcgcctccagtacttccgcgccgttctcaaatgtcgtacaggttaaacccgctccagcgagcgcacgttcaagcacccaacggatggaactatcgtcatcgactacccagactatccctcgttgcataaacgtcacctttatttcctgataggcaggtaaaccgagaactcggtatgacctggccaactggtaaattcaattttgcctgaatgctgatcaatcaaattacgggcgatggataagccaagcccggtgccaccttcgcggccgctgaccatcgggtaaaacagcgtatcctgcaaatgaggcggaatgcccggcccgttatcttccacatcaatccgcgccgccagccgatagcgctcgccgtgtaaggtcagttgaaacgctgtgcgggtacgcagaatgatttcaccaccctccggccccagcgcctgtagcgcattgcgcacaatattcagcaagacctgttcaatttgatccgggtcgtgcgccagttccggcaggctggggtcgtaatcccgaatcaaccgcacgttgttcggcagttccatcgacaccagcgtcaccacgcgttcagccactttgtgaatactttcggtaatacgcgtaccgggcagctgcggccccaacagacggtcgaccagatttcgcagccggtccgcctgttcgataatcactttggtatattcgagtagtgacgggtcaggtaatgccttgctgagtagctgcgccgcgccacgtaaaccgccaagcggatttttaatctcatgcgccaggccgcgcactaaatcacgggcagcaacctgctgggcgtgctgtagctgttcctgacttaagcggcgctggttatccatcggtgccatctccagcaggatcatgccgtccggcatacgctgagccgtcacagaaaggatatgcgagcgcccgtcgatgaccagcgtcacttcgttatcggtaaaaccttgccccgcctccagactttcttgcatcagctcgatatttaatgagaagtagctcaacagttccggtaacggcgtaccaaacaatttgcgggagctttgggcgagcagttgttgcgcggcggggttggcgtaatggatcgccagattgtcatcgattaacaaaatactgttaatcagcgagttgaggatctgcccagcatcgggctgcgtgcctgttgccataaagcagtctcctgaacaggttgcaccattttagtgcattatagctttttacggataaaaagcgcgaagcatcagagaattgacggagaaaaaagcccatgcagagatgggctgaaagtttccacggcaactaaatcccggcgttgttgcgccgggtagtacaacttcaactattagacgctgtagtacagctcaaactctaccggatgcggagtcatacgcatgcggtcatcttcttcgcgacgcagagcgatgtacgcatcgatcgcttcatccgtgaacacgccaccggctttcaggaactcgcgatccagatccagttcgttcagtgcttcttccagagagcctgcaacctgtgggatctctttcgcttcttctggcggcaggtcatacaggtttttgtccatggcttcgcccggatggatcttgttcttgatgccatcaagaccggccatcagcagggcagcaaagcacaggtacgggttagccgccgggtccgggaaacgtacttcgatacgacgtgctttcggagaagaaaccaccggaatacggatagacgcagaacggttacgcgcagagtaagccagcattaccggtgcttcgtagcccgggaccagacgcttgtaagagttggtggtcgggtttgccagggcgttaatcgctttagcgtgtttgattacgccgccaatgtagtacagtgcctgttcagacagacctgcgtatttgtcgccagcaaacaggttgacgccgtttttagacagcgacatgtggcagtgcataccggaaccgttatcaccgaacatcggttttggcataaaggtcgcggtcttaccgaaacggtgcgccacgttgtgcacgacatatttgtagatctgaatttcgtcagcttttttggtcatggtattgaagcgggtagccacttcgttctgacctgcggtagcgacttcgtggtgatgagcttcaactaccagacccatctgttccatcaccagacacatttcagaacgaatatcctgagctgagtctaccggcggaaccgggaagtaaccgcctttcactgccggacggtgacctttgttaccaccttcatattgggtggaggagttccatgcaccttcgatatcgtcgatagcaacgtgggaaccggagatagacgatccgaaacggatgtcatcgaacaggaagaattcaggttctggcccgaacagtacggtgtcggcaatgccagtagaacgcaggtaatcttcagcgcgcttcgcaatagagcgcgggtcacggtcatagccttgcagggtgccaggttcaaggatgtcgcaacggataatcagggtagaatcggcgaagaacggatcaatcactgcggtggatgcgtctggcatcagcaccatatcggattcgttaatgcctttccagccgccaatcgaggagccgtcaaacattttgccttcttcgaagaattcggcattcacctgatgagcagggatagtgacgtgctgttctttacctttggtatcggtgaagcgcaaatcaacaaacttcacttcgtgctcgttcagcatcgtcagtacgtgttcagcggacatactttaactctcctggattggtcattgtcgtcgtggtaacgaaatctgcaattaaatgggccgtgtcgccgtaaaaaagataaagcgaaatctgtgccaacttttaaattgcccctaaaaggcgttatcatgcttaacatcgtgcaaaagggctgcaccatgatgtgaatgttgcaccaatatagtgcttcaatgggaacattaagcaccatattggtgcaatgacctttggataaccctttttatgctccgtgaaagcgatcacaaagggactctgcaatacttgtttgcggaggatgtttgtgatcctgttttgtagtgcgattaatccgtgtacaataacgcgctatttctaatgcctgaggcaaagttgtgatcgaaaaattgcgtaatatcgccatcatcgcgcacgtagaccatggtaaaaccaccctggtagacaagctgctccaacaatccggtacgttcgactctcgtgccgaaacccaagagcgcgtgatggactccaacgatttggagaaagagcgtgggattaccatcctcgcgaaaaacaccgctatcaaatggaatgattaccgtatcaacatcgttgataccccggggcacgccgacttcggtggtgaagttgaacgtgtaatgtccatggtagactcagtgctgctggtggttgacgcatttgacggcccgatgccgcaaacgcgcttcgtaaccaaaaaagcgtttgcttacggcctgaagccgattgttgttatcaacaaagttgaccgccctggcgcgcgtcctgattgggttgtggatcaggtattcgatctgttcgttaacctcgacgcgaccgacgagcagctggacttcccgatcgtttacgcttctgcgctgaacggtatcgcgggtctggaccacgaagatatggcggaagacatgaccccgctgtaccaggcgattgttgaccacgttcctgcgccggacgttgaccttgacggtccgttccagatgcagatttctcagctcgattacaacagctatgttggcgttatcggcattggccgcatcaagcgcggtaaagtgaagccgaaccagcaggttactatcatcgatagcgaaggcaaaacccgcaacgcgaaagtcggtaaagtgctgggccacctcggtctggaacgtatcgaaaccgatctggcggaagctggcgatatcgtggcgatcacgggcctgggcgaactgaacatttctgacaccgtttgcgacacgcaaaacgttgaagcgctgccggcactctccgttgatgagccgaccgtttctatgttcttctgcgttaacacctcgccgttctgcggtaaagaaggtaagttcgtaacgtctcgtcagatcctggatcgtctgaacaaagaactggtacacaacgttgcgctgcgcgtagaagaaaccgaagacgccgatgcgttccgcgtttctggtcgtggcgaactgcacctgtctgttctgatcgaaaacatgcgtcgtgaaggtttcgaactggcggtatcccgtccgaaggttatcttccgtgaaatcgacggtcgtaaacaagagccgtatgaaaacgtgacgctggacgttgaagaacagcatcagggttctgtaatgcaggcgctgggcgaacgtaaaggcgacctgaaaaacatgaatccagacggtaaaggccgcgtacgtctcgactacgtgatcccaagccgtggtctgattggcttccgttctgagttcatgaccatgacttccggtactggtctgctgtactccaccttcagccactacgacgacgtacgtccgggtgaagtgggccagcgtcagaacggcgtactgatctctaacggtcagggtaaagcggtagcgttcgcgctgttcggtctgcaggatcgcggtaagctgttcctcggtcacggtgcagaagtttacgaaggtcagattatcggtattcacagccgctctaacgacctgactgtaaactgcctgaccggtaagaaactgaccaacatgcgtgcttccggtactgacgaagccgttgttctggttccgcctatccgcatgactctggaacaagctctggagttcatcgatgatgacgaactggtagaagtgactccgacctctattcgtattcgtaaacgtcacctgacggaaaacgatcgtcgtcgcgccaaccgcgcaccgaaagacgattaatttcgtttttcagtcataaaaaacctgccagcgatggcaggttttttttggcttttgtagacctgataagatgcgccagcatcgcatcaggaatttttacatcagaagaaatacttcgttccgatacgaatctggttttgctcgcggtggtacggctcgacgttgcggtctaaccagcgcaattcgaaataaggaagccagtgttcattaatacggtaacggaaggtgttagtgatttcccaatgatgatctttcccgttgctactattaaagtcattcactcgcatgaagtaatgttgttcaaatgtataggaaaatttttctgttattttaaagttccagtaggtgccaacttcataggtgtcgttattatccaattcgccgttcaaatctgtagagctgtaattattatggttatagcgattacgtaccgtcaggttaaaccacggagtaaatttgtagttaacatccagataaacagcaccacccgaaccgatactcttgtcattaattaagccaccgggctggatggttaatttatcggtaggtttaaataaaggataccaaccttcaatttcattatagccatgtttgagttcatcttctcgctgaaaggtgtaggtattggttagcataatacccgcgcccatatcgaagttataacccatacgtagcataacctcaccctgatcggaggcgagattatatgcttccctgttttcgacgtatgcgccagcgaataccgaggcagaggtcagagaagataataaaattattgcattaatatttttcataataagtccattttttaaacgtagggaggccgccacccatcaggatggaaatagcggctattgacatttataacgttacggaagccgttttttcttctgtctcaatttctttatttttgcgttggttaatttcctcaataatcagtgcaaaccgtttctcattgagcgtgtaaaagaaccccatcgtcaatgcagcaataattgccagcgcacaaggccagataaaaatgagctgacgcaaaccctgtaatgttgcatcgctttgcgcgatgttgggaatataaccgatttgcgtcagcataatgccgggcaagaagccagcaagtgcggctgaaattttacgaaagaaggtataaccggtataaacagaaccttcggcacgtatacctgttttccattcaccataatctacggtatctggtaccagtgcccagttcaggctgtttacaaaggccgtgccaaaaaaggcgacacaagagaacatgacgaaagtgaatgagttactgccccagcaataattcaggatatcccccaccgcccacagcaccatgccagccagataaacctgttttttaccaaaacattttacagttagtggcaccagtaatacgccgacgagaatgcatcccatactaaagaatcccatccacgacaataagttaatatcattcagcacatactgggtgtaatagacctgaatcgccagtttgatattaaatgccgccagggtacacaggttagcaatgcacaataccagcaaaggtggattacgaaatatcgcgcaaaatgatttgagaatactggccttatgtccggttggcgtcgtgtccacataatgctctttgacacctctgtagcacagcatcataaaaataaagccgccaatggagaacatcagtgccgcgcaggcgtagccgacggtggagtcagaaaatagtgactgcaaaggaataaacgccacggtacagatcaatagccctatggttgcaccaccctggcggtaagcagcgagttgcgcgcgctcattcgggtttttggtaatggccgggatcatcgcgccatacgagcagttcatcagactgtatgaaagtccaaacatcataaacagtgcggtggcaatcgtcgttttaaccggcaaactaaaggtggtggcgataaactggagcgttgcaattaacgccgccggaatcgctgcgtataaaataaacggcctgaattttcctttaggtccaatatttttccgcgagtcgagtaaaaatccggtgagcatatcggtaaatgcggtaaaaaacttcgccaccagaaagataatcccgccatagtaagcaggcatccctaattcatcggtataaaatttgaggagatacagagtgccgatgctaagcattaaattcgaaccgacgtcgcccataccataggcgattttttcccgcagattcagttttaatgtcagtggattatggtcagacataatcactccttataacgccccgcagggcgttgtttattataattacgccgtgcgtttacgggcttctatctcttcaacaatgcggacgtacatcttctcgttcagactgtagaagcaacccattgccacaatggtgactactgccagtgcgcttgggtagatgaagatcagttggcgcaacccttcgatagtgtggtcagcctgggcgacgtttggcacatagccaatttgcgtcagcatccagcctgggaagaaacctgccagcgcctgagatactttgcgaaagaaggtgaaaccggtgtagaccgtaccttccgaacgcacaccggtgcgccactcgccatactcgacggtgtcagaaaccagcgcccagttcaggctgttaacaaacgccgaaccaaagaacgccaggcaggagaaagccacaaagctgaccgagccgccgccgaagaaatagttgagcagatcgcccagcacccagatcagcagaccgccgatatagaccttcttcttaccaaaacgtctgactgcaccaggcatcaggaacacgccgatgaaaatacagcccatgctgaaaaatcccatatatgacaacaggatgggatcgttaagcacgtactgggtgtaatagacctgaatggcgagcttgacgttaaacgcccctaaggtacagaggttggcaatgcacaaaatgaacagtgggcggttccccgcaattgcgcggaaagattgcaacaagccaggcttttgcgccggattggtaggttgggttttgacataacgctctttcacgcccgaatagcagatccacataaacagcaggccgaacagtgaaaacagcgtggcggcgaagatatagccaagttgctgattaccctcgataagattcataaccggcacgaatcccaccgtacacagcagcaggcccaatgtagcgccaccctgacgccatgctgccagcgatgcacgttcgttggggtttttagtaatagcggggaccatcgcgccatacgagcagttcatcatgctgaaaaacagtccgtaaagcataaacaggatggtggccatcaccgttttaccggtgacatcaaacggtgtgccgacaaagttggcgatctccagcagggtgaccggaaatgacgcatacagaataaaaggacggaacttaccttttggaccgatcttgcgtcgggaatccaacataatgccggtacccatatcggtaaaggcggtaaagaattttgaaatcaaaaagataatgccgccataggtgccaggcagccccagaacatcggtataaaacttcaaaagataaagcgtgccgatatccagtaggatgttagaggccagatcgccgataccgtaagagagtttctctttaaagggcaggcgtagagttgctggatcttccgttgtgatgtgactcatcgttgttctccctttgcccgtgagtttccccacgggcggatgtgattagatgctttttaacgacgcgaacagtgccgcccattcgctatcggcgcgataaaagaccggcggtttaccgatgggcgcattaacggtcacttccccgccccggaacgcttcacccgtccaggcatggacccagttatcctccggcagatagagcgtccagtcgctgcgaccttcttcgtgtaccggggcgaccagaatgtcgcggcctaacaggtactgatatttcagggtgtaggtctgtgcatcgtcttcgtaatgcaggaacagcgggcgcataaccggcaggccggacttcgcattcagcgcgacggcctctttcaggtaaggtttcagggtagtgaagacggtggtcatacgggcaaaatgggcgatagtttccgcgtcgccgtcaaactgccagttgtcgccaggacggttaccttcatgggtgcgcatcatcggcgtgaaggcgctgaaatcgcaccagcgcagcagcagctctttgctgcgcttcatctcaaacagggtggtgtaaccgccaatatcactgtgatgcaggccatgtccggtcattgccagcgacagcgccgccgggacgacagacgccagtccatcgtccagactccagtcaacgttctggtcgcccgcccacatcatggtggaatatttttggctaccggtggaaccggcgcgcataaagaagaggatctcgccgagcttgcccgtttcttcaagggcttcgtagttacatttcgcccacagcgcaggccaggcgttatgcataatttcggcgctgacgccgttatgcaggtaagtgtcggtgggcagatactcgccgaagtcagccatccagccgccgcagccgagttcaatcatgttctttttgatcacttccttgaaccaggcgtaggcttccggattagtgagatcgacaacgccgccgtagaactcgccaaactccaccagataatcgccgccggcggcatcttttgccagatagccgcgctttgccgcttcttcgcagaggtctttatcgctggcaacatacgggttgatataggcaaggaactgtacgccctctttgttccactgcttgatacgtgaatccagttgcgggtagttttcgctgttccacttccagttccacattacgcgtttgccaaaagaggtcatacgaataccggaccaatcctgcgcccagatgccgttgaccttcacgcccgcgttacgcatggtgtccagtttcttctggcacacctcagtgccgccctgaatgccgagcgttactccgtcataaatccagtcgggcagttctggctggcgtcccagcagcgcggttaatttttccagcagggagatgtatgtatcagcacattcaaaacgcagtgttgctttgtcttcccacagcgccagttcatggtattccggcgcgctaaagtcgaagttcatatagcaactgttatcaacatggcagtaatacttctgcgtgctaacaaacgtgggttgtggaaagaaggtccagtagtaatcccctcccgcattctctttgcagtcggcctgccaggtgacataggtttgtttgttgcgaccaacgccttgttcactggtccacagcgggaacggtttgccgcgcagatcaaagtaggagaattgttcgccgcagccgtagatatgatcttccggctgtgcggcaaggcgcagccagatgcggttgtggttaaggttgtcgttttgtagttccagcaataaacggccatgatcgtcggcagagatattcagcgtggcgctaatgtcagaaccacggctgaaatggattaaccagccattcggtgactggctgacgatggcgtcggtaagcgcaattttctcctgcaatttatctttaatgctgaaattaccgcggaacatatcgatatccgctatacctgaaccaatccataaacaaggattatctttgctatggattaaaataaggcggtcttgaaaacgtagagtaaaactgtcgttattctgatgaaattgaaaatctattagctgtgggcgtggcgtatccataaataatctccatagatataaaactaatatttcatgccatcctgttattacaggtttcattaattaaagaatgtgtgcgggtataaattaaaacccgcataatgattatttactttcttcagcccgacggattgccgccacttttttaccaaatgccagttgcagtataactaacaaggtaaacggaggaagaagtgcggcagcggcgggaattcccagcgcgccttttatcaacatagaaccggaggcaatcagcaataaaaagaccatcacacggaacactttgaccgaaatgcgtttatgcacatattgtccaaccagtgaaccgaggatcatggtgggaatacaaaacagcaccagtttaaagatagagacagtcaaaattccgctggtcgccagcccgccgatcaccgcgatgttgtttgcggtgaagaaagcgttcagagtgccgcgaaatgccgccgggcctaagttacgcagcataccgtagataaccatcggcggtccgttggttgaaaatgctgcccctaacgctcctgccacggcgccgataggtgcggcgatccagctacggtcataaatcggcaggcgtggaataaacatactgtaaaaggagtacaggataaggaatccgcctaagcccactttcataaaatggtcgggtaaatacgacagcgcatataaaccgacgggtattcccagaaacgagaaaataatcagtaccattgccgatcgccaatccgtttctttacgtgacagccaggtggcgtacaaggcggtcgcggtgccgacaatcaccgagagcggagttgccatttttacggggagcattaacgtgacgagcggcatggtggttaaaccaccgccaaatcccgcgcatatccccacaaaggtataaagaaacattaacgcgataacgatacataccacgtttgtttccagcatgaccccatccggtgaaaataacgtaaaaaagtccataatatttcctgttgtgtaaatacaactctaaacaatgatctcgttcttttcttaataaaattaattgtgctgcccgtgaatattaaaaaacaggcggtgcgttttccctggttccagtaataataagtcgatacctgaattaaaggcgttaggcgggcaactcattggttcaactgccagtccctgacgttgtaatttttcaccgctataaacctgcacccagggttgatcggaacagaggctcaccgaaagcgcctgctgtggatgggtaatagtcatttcccacaaatcattagcggttttaaaggtgtggtcgatttttgtcgcggctatttttttcgcctgcgtgaaatttaaatccagctcatcaacgtggtgaagcgttgtcggattagcgtgctcatcgatggcataaacttggtttgccggaagctggaacagatattcatcaacagatgttaagttgcaggttaaataagggtgaatacccacaccgtaaggcgctgcgacagtgccgatattctggcttgcgatctcaacggaaagacccgtgcgggcgttgagcgaataaaccacctgcgaagccagcataaacgggtagccgtaactgggtggcagaaaggcggttaatgtgacgctggtggcgcttaattcgctgatttgccagtcacgccaggcgagcagcccatgaatagcggcttttgaaccatgttcattaatgggtaactgatattcctgcccctgatagcgataacagccgttggcgatccggtttggccacggaataaggactttgcccagatgtgccagcggcatctcttcgggtttatgcggaataactaaatgacagccctgaaaggttaattcagccagacctgcaccgacggtcacaatggtcgcgtgataatcccccgcggcaagtgaaacggtctgtccactgcaatgcatgttggtgatttgcatacgaggtacctttattgaataacgacatacccggcgtgcagcctgatatgtcgtttttttagtcagttatttcgcgttaatatccagcagacccgccgcaaccgccggagccaggcctggcgctaacgggatacgtgggatcaccagacaatgcagcagatgataaatatcctgtttgccgtcccagactttggtggtgaccttattgtccgcatccagctcctgccaccatgaaccattttcgtagtccatcaggtatttgatgcagtagtcccaccatgtctgataccaggtttcgtactggcgatcgccagtgacggtgtagagcgcgtaggccgtacccatcgcttcgacgataggccaacgcacacgttcgcggaccaccggttttccttcccagtcaacggtataaacaatcccgtccgcgccatcgggtgcccaggcatcgcgcacggtggcgttaaacagacctttggcatcttctagcagccatgctggcggttgttcgcaacgggcttccagggccgcgtgaatgtgcagcattaaacggccccattcgatccagtggcccggagtacctccgaacgcgcggaagcggtgcgccgggttatctttgttgtaatctggcagcggattccactgggtatcgaagtgttcgttaacgcgataatgattatttctggcgacgtcgtggataatcacggaagccacgcgaatcgcgcgatccagccattttttgtcatgggtgacgtcatagacaatcaggaaggcttccaccgcgtgcatattggcattgccgccgcgatactcttcggttttgctgaaggcttcatcccaggactccaggcacatctgctcttcttcgctccagaagtatttctcgataatttcaatggtgtaatcgagcagcttgcgcgcttccggatgaccggtagtgacggcgctggcagcacccagcagagcaaagaaatgttgatagccctgtttggaggcatccaccacgccctcgtcattcacgcaggcataccaaccgccatattttttatcgtgcagtgcgccattcatggctttgataccgtgatcaaccaacgagtaagcgccaggtcggcccatcgccgcagcaacggaataaacgtgcaacatacgagctgtgatccacagatgggtgcccatctcttctttgatttgccctttattgcctaaccagccaaatccggtcggtactacggattttttaccaaaatcaaagatgcgatcggtttcctgttccagccaacggttgtgacttaaagtgttaaaccatttcatttttgtatccccatcttaacggcgtttagccatcatttcgtcgacgatatcgccaagttgttgtaatttcggtgcgcaaacgtcacgcagcatcagctcgttgtctggtaaaccgacgaccgatgcccagacggcacgaccagccaggaagcccgatgcacccgctgtcattgccacgcgtacggcacgcgggaacagtttttcgtcgacaccggaagagaggatcacccacggcatattgatatggtcattcagacgttgtgaagcactgagaagctcttgttgcggacctttaccgtaaagcggcatttcaactttgtagagatcagcgccactgtcgcccagctctttggctgcatcgatgattgcttgttcgcgatcgaatttatcgccacgacgcggtgggcggacgactggctcaatgatgcttaccagaccgtgtgagtggcacatttcgttaaactctttcaccatatccaggcgttgctgcgcatcttcatcactacgccacagcaccagcagttttaaggctttgccaccgtcttgtttggtttgtagcggattgattttgcggtcaatgaccacgctatctaccggaataccgttgccaggaatgaactcatcggcggcgacaatcatggcgcaacttttggcaatcgcgttttgctcaaccacctggcggtagcagaattgttgatctaccagaatcgccgatgcataaggtgaaagagtcttcgcggcgttaactttgaaatcagttaaaactctatcggctactggagcgggtgcgccagccgcggcaaacatcatgcgcatggcttcgcgctgatcgaccgccagcatggcaaaaccgcccgatgcacgcgtaatgtcgttgatggtgtacttattcattcatttattcctttatccagtcgttacatttttactttggcagtcatcccggcactgacacggacctgctccagaatggcggaccagtcctggcgaccgcgacccgctgcgcgcgcctggctataaacctcccgtgaggcggcccccagtggcatcggcacatgcaactggttggcgacatcaagggcgatgccaagatccttatgggcaagatcgatcatgaaggcgggagaaagatctccgctgaggactttgttcggccaggaagtggtgaagtggcctttaccggcggcagtaccgctcattaccttgacggcaacatcgaagggaagattgagggcttcgcacaaaacggcggcttctgccgacaacgcattgagcgcgatgctcatgtagttgttgataagcttaacgcggatccccatgcccggaccgcccgcgttgatcaactcgctgcccatcgccatcaggatcggcgtggcgcgttcaacttgttcagcagtgccgccagccagcagtagcagagtaccggtaatggcatttgcggaagtacggcctaccggaacatccatcatgctgaagcctctggcctgcatatcagcaatcaatttatcggtttgcagtgggtggatggtcgacatatcaatgaccagcgcatcggaagataagctctcacagacaccgttttcaccgaacaacacgtgacgcaccagatcgccattcggcaacatggtaatgataaattcggcacctttagcggcctgcgctgggttagcagcgggagtcgcccctttgtcgaccagatgctgtacggcttcggtattcacatcgaagacgcaaagttgatgcccttgctgcaataaattgctcgccattggcgaacccatttgccctaaaccgataaacgcgattgctgccataactctctcctgaatacagtgatgtcactttttgtcatttatgacatgccttgcttgtctgtttttgatcgtatttgtaatttatcgtcaaaaaattgacagccgtcactttttaaacaattgatgaaattaaaatgaacgcatcccaaaatgcttaaggaatgaccatgattcgtgttgcttgtgtaggaattaccgtgatggatcgcatctattacgtggaaggattgccgacggagagcggtaaatacgtggcgaaaaattatacggaagttggcggcgggccagcggctacagcagcagttgcggcggccagactaggtgcgcaggtcgattttattggtcgcgtcggtgacgacgacacgggcaacagcctgctggcagagctggaatcctggggtgttaacacccgttacaccaaacggtataaccaggcgaaatcttcgcaatccgccatcatggtggatgccaaaggtgagcgcatcatcattaactatcccagcccagacctactgcctgatgcagagtggttggaggaaattgatttctctcagtgggacgtggtgctggcagatgtacgctggcacgacggcgcgaaaaaagccttcactctggcgcggcaggcgggcgtaatgaccgtgctggacggtgatattacgtcgcaggatatcagcgaactggtggcgttaagcgatcatgcagctttttcagaaccgggtctggcgcgcttaacgggcgtgaaagagatggcgagtgccctaaaacaggcacaaacgctcacaaatggacatgtctatgttactcagggcagtgcaggctgtgactggctggagaatggcgggcgacagcatcaaccggccttcaaagttgatgtggtagataccacaggtgcgggtgatgtttttcacggcgcattggcggtggcgctggcaacaggtggggatttagcggaatcagtccgcttcgccagcggagtagcggcgttgaaatgcacacgtcccggtggacgagctgggatccctgactgtgatcaaacccgatcttttttgtcactttttgtataaaatgccagggtgatggtttttcgaggaattttcatgagccttaccgaactaaccggtaacccgcggcacgaccaactcctcatgctgatcgccgagcgtgggtatatgaatattgatgagctggcaaatctgctggatgtctccacgcagacggtccgccgggatattcgtaaattaagcgagcaaggactgattacgcgccatcacggtggcgcgggtcgggcttccagcgtcgttaatacggcgttcgagcagcgtgaggtttcgcaaaccgaagaaaaaaaagcgattgccgaagcggtggcagactatattcctgatggttcaacaatatttatcaccattggtacgaccgttgagcatgttgcccgggcgttacttaaccataaccatttgcggataatcaccaacagcctgcgtgtggcgcatattctttaccacaacccgcgctttgaagtgatggtgcctggcggaacgctgcgttcccataacagtgggatcattggcccttcagcggcgtcctttgtggccgattttcgcgccgattatctggtaacaagtgtaggcgcaattgagagcgatggcgcgttgatggagtttgatgttaacgaagctaacgtggtgaaaacgatgatggcgcacgcgagaaatattctgctggtcgccgatcacactaagtatcatgcttcggcggcggttgaaattggtaatgtggcacaggtcactgcgctctttaccgacgagctgccgcccgctgcgctaaaatcacgcttacaagacagccaaattgaaatcatccttccccaggaagacgcgtagaattttgtgaccgttgacctggcttcatacctgaccacatagccaaacccatcctttcccgctacagttaatttcttgtggcgcgaaaggaggcaaaaatgctctatatctttgatttaggtaatgtgattgtcgatatcgactttaaccgtgtgctgggggcctggagcgatttaacgcgtgttccactggctacgcttaagaagagtttccacatgggcgaggcgtttcatcagcatgagcgtggggaaattagcgacgaagcgttcgcagaggcactgtgtcatgagatggccctgccgctaagctatgagcagttctcccacggttggcaggcggtatttgttgcgctacgaccggaagtgatcgccatcatgcataaactgcgtgagcaggggcatcgcgtggtggtgctttccaatactaaccgcctgcatactaccttctggccggaggaatacccggaaatccgtgatgctgctgaccatatctatctgtcgcaagacttgggtatgcgcaaacctgaagcacgaatttatcagcatgttttgcaggcagaaggtttttcaccagacgatacggtctttttcgacgataacgccgataatatagaaggagctaatcagctaggcattactagtattctggtgaaagataaaaccaccatcccggactatttcgcgaaggtgttatgctaaaaaccattcaggacaaagccaggcatcgtacccgtccactatgggcctggctaaaactactctggcaacgcattgatgaggacaacatgacaaccctggcaggtaaccttgcctatgtgtcgttgctctcattagtgccgctggttgccgttgtttttgcgcttttcgccgcttttcccatgttttccgacgtcagcattcagttgcgtcactttatttttgccaactttctgcctgctactggcgatgttatccagcgatatatcgaacagtttgtcgccaattccaacaaaatgaccgccgtcggggcgtgcgggctgatcgtcacggcgttattgttgatgtactccatcgatagcgcgttgaataccatctggcgcagtaaacgagcgcgacccaaaatttactcgtttgccgtgtactggatgattttaacgctggggccgctgttggcaggggccagtctggcgatcagctcctatctgctctctctgcgctgggcgagcgatctcaatactgtcatcgataatgtgttgcgtatttttccgctgctgttgtcgtggatctctttctggctgctgtacagcatcgttcctaccatccgtgtacctaaccgcgacgcgattgtcggcgcgtttgtcgccgcgctcctgttcgaagcaggaaagaaaggtttcgcgctttatatcaccatgttcccatcatatcagctcatttacggtgtgcttgcggtgatccccattctctttgtttgggtctactggacatggtgtatcgtcttgcttggcgcggaaattactgtcactctcggggaataccgcaaattaaaacaagctgctgaacaagaagaagacgacgaaccatgattgcattaattcaacgcgtaacccgtgccagcgtcaccgtggagggagaagtgacgggcgaaattggcgcgggacttttggtgttattgggtgtcgaaaaggatgacgacgaacagaaagcaaaccgtctgtgcgagcgtgtgcttggctatcgcatcttcagcgatgccgatggcaagatgaatctcaacgtgcaacaggcgggcggcagtgtgctggtggtttcccagtttaccctcgccgcagataccgaacgggggatgcgcccaagcttctcaaaaggcgcatcaccggatcgcgcagaggcgttatatgactatttcgtcgaacgctgccgtcagcaggagatgaacacgcaaacagggcgcttcgctgcggatatgcaggtatcgctggtcaatgatggccccgtgacattctggttgcaggtatgagccagcttccaggtgtgtcacgggaaacaagagagagtatcgctatgtatcaccttcgggttccacaaacagaagaagaattagagcgctactatcagttccgctgggagatgttgcgtaaacccctgcatcaaccgaaaggttcggaacgcgacgcgtgggatgcgatggcgcatcaccagatggtcgtcgacgagcagggtaatctggtggcagtagggcggctgtatattaatgccgataacgaagcgtccatccgttttatggccgttcatcccgacgtgcaggacaaagggttaggcacgctgatggcgatgactctggagtcggtggcgcgtcaggaaggcgttaagcgcgtgacctgtagcgcccgtgaagacgcggtggagtttttcgccaagctggggtttgttaatcagggagaaatcaccacgccaaccaccacgccgattcgccattttttgatgattaaacctgtcgccactctggatgatattttgcatcgcggcgactggtgcgcgcagctgcaacaggcgtggtacgaacatatcccgctaagcgaaaaaatgggcgtgcgcattcagcaatataccgggcaaaaatttatcaccaccatgccggaaacaggcaatcagaatccgcatcacacgctgtttgccgggagtttattctcgctggcaacgctcactggttgggggcttatctggctgatgctgcgcgaacgccacctcggcggaacgattattctggcggatgcgcatatccgctatagcaaaccgattagcggaaaaccccatgcggtagccgaccttggtgccttaagtggcgatctcgaccgtctggcgcgcggacgaaaagcacgggtgcagatgcaagtagaaatctttggcgacgagacgccgggtgcagtgtttgaaggcacgtatatcgttctgcccgcgaagccatttggtccgtatgaagagggcggaaacgaagaagagtaggggcgttttacttgactgaaaaggttttcaatctgaaaaccttttctgggccctggtccggagttaccttcccgctctccaggcaacatcccgtagcgccgatcgcgcagcctcactgataccacctaactgaaaaaatccgtggataacgccaaggtagcgttggcaggtgcattgcactccttgccctgtcatgcggtgatacaacgcttcaccttcatcgcaaagtgggtcgtattcagcggtaatgatatgtacaggtggcaagccattgaaatcattgcgccaaatagggctggcttcaggatgcctgcgttcaatgcctggcaggtacatctcaaagccgctcagtaaagtgtcgcgtgtgatgatgtaatcgtgaccattgcgtatgtagctttcgaaatgcgcagtcgcatcaagcataggataaattaagatgagttgtgctggttgccactcgccagcacgcttcaatcgcaaagcagttaccagcgccagatgccctcccgcactgtcaccggcaagagttattcgttgtttatcaacgccgagtcgttcggcgtgttgccggactaattctgcacctcgttgtgcatcatcatgggcggcggggaaagtatgttccggtgccagccgatactggacggcaataatccgacattgcccgtaataggctaactggcgcagctggttgtcgtgagttgcgaacccgccgctaacaaaacagccaccgtagtaataaattatcgtcgggagtaatgtcggggcattcagcggtgacactattcgtaaggtcatcccttcaagttcgatagtctgaatatctacccgcgtttctgtctcacccgcaaggacagcgctggcgatatagccctctctgcgctgcgtaatactttgttggcgcgatgaggggcgacccgcagcgataaactcttcgactaactctgcaattcctttttccagtgccatagtagaactcattttgctgtatgaatgtacagttttatacacccgtttttgctggatggatacagggaaattcacgggcgtgaaaaatctggaaagcgcctcgcaaatgtaaagacaaacccggcagagacgtggttttgctggagcactatcagtaagctagtggtttcaatggtacgtcaatgacgtacaaaaaggattgttactctaagccaatggcgtataattatgctcttcatcgaaacggaaatttttactgaagatgttcaaaaactgctgaacgacgatgaattcagtcgttttcagtttttcctggccttgaatcctgactatggtgaggtaatacctgaaactggtgggttaagaaaggttcgatgggtctcaggaggaaaggggaaacgtgctggtgtcagggttatttactttcatcaggttaaacattatgagatcagattactgcttatttatcgtaagggtattaaagatgatctgtctccccaggaaaaagcaatgctccggttgttaaatacgaggtggtaaatggataaggcactttttgagcggttgactcacagcatggcccagatgaatgaaattattgaaggaacgcgacagccttcacgtacttttgaagttgatgctatgaaaatcaaagaaatacgccgcgcttcagggttgtcacaatctaaatttgccgatcttatttccgtaagcgtagacacgttgcgtaactgggagcaggggcgacgttcaccgaccgggcctgcaaaggctttgctgcgagcgattgccaatgatccgcaacatgtgctgcaagcacttaaccgttagaggcatggttatgccatacagaaagcaccagcattcagaactcctatgaaagcggcatagtgccgcctgctcaggagttttgctatgacccgtaatcgtgctgaacgtcgccatcatatggtgcgattaaaaaaaatccgctgtcgttatcgcactgcaggcgatggaagcaaaaaagcatcaggtatttgctttcgtactccctgtatttgttcttgttggatgtgtgggcatcgacgctatcataatggtccccgcgtatcggaaattcgtgcaaaagcacgctatgcgaattaagggaaaatgatgaactattttaaggaagcacatttttagaactcttaacaggagactaaaaatgtccacgtttaatacgcgtaaagatagggatcgtaatggtaaagcgaagccgcataagcattcagggatcccaacacttacaggtaaatggcgtcacccttcaatggattgttgggtaaactacagtacaccgggcgatcatgaatggaagcggctctatactacgcttcgccgtcgcgcagatgatcgacgccaatgtcatcgggtaatgcagggggatgatccggaaggaatcgtctggttcccggactgttatccacaaatttactactactaacaattaaagaccggttggtgcggcactgaccggtcgttatgaatggtagatttcaccttaaaccctggtgcggtaaagctgctgactttttcgggtacaccatcctgatgaagcaaatgaagacccaatcaaaaaatattcttgaatataaaatatttatagcatccataattcatccttattatttgttgtttcttttctgtagatgtgcccccgcttaattaaaagtaataaaccatttttgagtaacaattgaaataactgaaactgttacattatctttggatgccgtctcgcaaaaacaaaacaatatgaaaaaatccgctttcgttaattaactttccggcgtaattttcgcacatacattaatgagtaatatatgtaaggtggtggtaatggcgatgaatacggtttttcttcatttatcagaagaggcaattaaacggctgaacaagcttcggggatggcgtaaggtttcgcgctctgcaattttacgcgaagcggtagagcaatatctggagcggcagcaatttccggtgcgtaaggcaaaaggcggcaggcaaagggacgaggcagttggtgttgaagaactatgtaagcagcataaggaatgacaaaagtttttttattcatgaatataaaaaaccagatgcccttattctggtattaatacaaggctgttttacttgaacttataataactgcaactgttacatcatatctggaaaacgcctcgcggaatacgagagattttgcgggaatagcaggtgtcgtcacaccctatgagctgtaatccgggcgaccagcgccacccggaaaacgtcagagattactccccttcacccggaaacaggaacgggttaatggaactacgggcatagccttcttgctccattcgcgcgtccagtaccagagaggcgaggtcatctgccacggcttcaactttcggttctttttcctgataaagaatcttcaggtaagtgccgcagtcatcgcagctttcggctttaatcgcggcctgttcgtcatccagcgaccagtaatgcagtttgccgctttgttcacagttgctgcattttacgcgcactacgtgccattcagtttcacacaggttgcagtgcaggtaacgcagaccctgagtggtgccaatttgcaccatgctggacaccggcatagagccacataccgggcaatattgacgttgttcgccgtattcagcgcgggctttgccggggatcagattagccatctgcgcccagtagagcgacagcgcagcccagataaacggcgctttatcgctgctgacggacgagaaatcagaggcaaacagtgcgctggccatatcttccagctcctgagtcgatgccttctccagattctcaatcactgccagcgccgggccgctcatttcaggtttcagctcagcaatcagcgccatcagcagcttttgccagtgcttatcacgcggcagaacgtgaatatccagcgggggcttgccttgtgcgctggcttctttaatgcgcgtggtcagatccatctccagcggatggtcgtacagcaccacttcctgggcgtgggcgataagcgcagcaaagcgcaggtaatcacccagcggattattttctgccagctcgcgcagacgctcggcgcggcggttgtataaattcttgagccgagggaacaataacggcggaatcatatccgccgtacgtttctcgctcgaacccagctcatcttgcgggattatgcgaatactcattcagctttcttttccgttgtcttgcggacctcacggtaccagcgcgggtgatgtttctttgcccatgcgctggtcacccatccttccaccatggcggtaatcgtgcctttcacccaaagggcggcgtagatatgcaccatgataaccacaattaacgccactgcggcaaatgaatgcagcattaacgcgaatcggatcaccgggattgagaaagcaggcgcaaaataaggacgccagataatcacgccgctcaccagcaacaggaccaggaaaataatcgccgcccagaaaacgcatttctgaccgaagttataacgcccggtgtcacttacttcctcgttgacgacgatcttacgaatattcttcgcccaaaagatatcatcccgattgattaggttgtgatgccagtaacggaaaaacatgatgatgaacgaggcaaacataaccacgccgacaaacgggtgcagaatgcgcgccagctgcggtgtgcccatgatttgcatcaaccagttgaaggacgggaacaaaaagcccagcccgctcaccgccgctaggatgaagcagaaggcggtgatccagtggttgatacgttccggcgcggtgtagcgcacgatggtgtcacgtcgtttcatttgcgctcctcgtctttctcttcgtgcagattattctcttcctcatccgcacggttcggaccgacacccacgtagtggaagatactggctgcgaaggtagccgcaaagccaacagctgcgagcggtttccagatgcctttccagaatttcacggtttcgctgatttccgggttctccggcaagccatgatacagatttggcttgtcagcatggtgcagcacgtacataacatgtgtaccaccgacgcctgccgggtcgtacaaacccgcattgtcgtaaccacgggttttcagctccgccacgcgctcgctcgccagcgttttcatcgactctttcgtaccgaagtgaatcgcgcccgttgggcaggtcttcacgcaggccggttcttgcccaaccaccacgcggtcaacgcacagcgtacatttgtagacgcggttgtcttccgggttgaggcgcggaatgtcgaacggacagcccgcaatgcaataaccgcagccgatgcactgctcggactggaagtcgacgataccgttggcatactgaataattgccccttccgccgggcacgctttcaggcagcctggatcggaacagtgcatacagccgtctttgcggatcagccattccagtttgtcgttctgctccacttccgagaatcgcatcaccgtccacgatttggcacttaaatcattggggttgtcgtacaccccaatgttattgccgacggtatcgcgaatgtcgttccactctgaacacgccacctgacaggctttacagccgatacaggtggtaacgtcgatgagtttcgccacttcttcctggaagtcccgcgcctgaggcgcgggggtcagaccgttagtcgcggaacgacgaatgatatcttgcgattgataagccatatgtcgtctccgttacaccttttccacattcacaaggaaggacttaaactccggcgtctgcgtgttcgcatcaccgacgaatggcgtcaacgtattggcaataaagccttttttcgcaacaccttcatagccccagtgaataggaataccgatggtatcgatatctttgccgtttgctttcagcgtgcgaatacgtttggtcactaccgctttggctttgatatagccacggttggaggagactttcacagtatcgccctgggcaatgccaagtttattcgccagcgactccccgatttccacaaactgctctggttgcaaaatcgcgttcaacagcgcgtgtttggtccagtagtggaagtgctcggtcagacgataggtggttccgacatacgggaacttatcggctttacctaacgcttcggcatcgtctttaaagatacgcgccgccggattcgagataacgtttggatgcagcgggttagttcccagcggcgtttcaaacggctcgtagtgttccgggaacggaccttccgccatcttatcgagggcaaacagacgtcccatgccttcctgctgcatgataaacggccctacgccgctgcccggaggcgctgcgctgtaatccggaatatcccagccggtccacttagtgccgtcccatttcagcaactgacgcttcggatcccacgggttaccctgcggatctgcggaggcgcggttatacagaatgcggcggttaagcggccatgcccatgcccagcccagcgtgttaccgaggccagacggatcggcgttatcacgacgcgccatctggttgccttccggcgtccagctaccggcgaaaatccagcagccacaggaggttgtgccgtcatcgcgcagttgggcgaacgagctaagttgttggcctttcttgacgataaccgcaccggttgccgggtcggtaatatcggccagcgctttgccgttgctctccattgccacttcttctgaagatggctcatgcggaatggcgtagttccaggtcatgttcagcacctggtccgggttcgcgccaccctgttcggcatacatcttgcgcaagcgcaggaagataccggagaggatctcgccatcagtcagcgcaatccccggggcgtccgcacctttccagtgccactgtaaccagcgacctgagttaacgatagaaccgttctcttccgcgaagcaggtcgatggtagacggaacacttcggtctggatcttcgacgagtcaacttcgttcagctcaccgtggttctgccagaagttagaggtttcagtgttcagcgggtcgatagtcacgaggaatttcagcttcgacagacagccgatcactttgtttttgttcgggaatgaggcaacagggttaaagccctggcagatatagccattgaccttgccttctttcatcatctcgaagtattgcaggacgtcgtagcctttatcccacttcggcaaccagtcaaagccccagctattttccgccgtcgctttatcaccaaagaatgccttcatcatagagacgaagaatttcgggtagttgccccagtagttaacctggccttccagcagtggtttcggcgtgttggcggtaaggtaagtttgcagatcggtctgcttctcgcttggcagcgtcatgtaacctggcagactctgcgacagtagccccaggtccgtcagcccctgaatattggagtgaccgcgcagggcgttaacgccgccgcctgccatccccatgttgccgagcagcagctggatcatcgccatcgtacgaatgttttgcgcaccaatggagtgttgcgtccagccgagggcgtagaggaacgacgctgttttatcgtgagcactggtttcggcgatgtattcgcagactttcaggaacgcgtcttttggcgtaccgcagatgttttcaaccacatctggcgtataacgggaaacgtgctgtttcagcaagttccacacgcaacgtggatgttgcagggttgtatcacgtttggcgaagccgttttcgtccagttcgtaagtccaggtggacttatcgtacttgcgtttttccgcgtcgtagccggtgaacaggccatcttcaaagccgtaatcctcacgcacgatcaggctggcgttggtataggcttcggtgtattcgcggttgaatttttcattgttcagcaggtacagcaatacgcctgacaggaaagcaatgtcagtaccggaacggataggggcatagtagtcagccaccgccgctgtacgtgtaaagcgaggatcgataacaatcagctttgcgccgttgtgaattttggcttccatcgcccagcggaacccgaccgggtgagcttcagcggcgttaccgcccatcaccacgacgaggttggcattcttgatgtcgacccagtggttggtcatcgcaccgcgaccaaatgttggagcaagacttgctaccgttggtccgtgtcagacacgcgcctggttgtcgaccgcgagcatacccagcgcgcgggagaatttttgcgttaaatagccggtttcgttactcgacgcggaagcacacagcatcccggtggagagccagcggttaacagtcacgccttcggcgttttgcgcaatgtagttagcatcgcggtcttctttcatcagtttggcgatgcgatcaaacgcctcttcccaactgatttgttgccatttatcagaacctggcgcacggtattccggaaacttcagacggctttcggagtggatgaaatccaccaggccagcgcctttcggacaaagtgctccgcggttgaccgggtgatccgggtcaccttcgatatggaagatagatgctttggcgttttttgctccgtcaccgaggctgtacatcaacagcccacagcctacggaacaataggtgcaggtattacgggtttcgcgggtgcgcagcagtttatactgccgggtttccgcgagtgctacgctgggtgcaaaacccagtgccgctgccgtggtgcctgccataccgccagcgcagatcttaaagaactgccttctgctgacctgcatggattgctccttgtttcgacattgtcacgtcccatttacattcgcttgctgcgtgtgcagggagtgggagttatttttctttgcggaaggggccgcaaaggtccagaattggctcaatttccctccatccaggaagggtttgtaacagaataccataatgttggtgtgtgtgttcttatctggttaatagaaagtgaaaaaaacacagcaaaaagaaatcgagaatgtgacaaatatcacaggtgttcgtcaaattgagttatggcggcgtgatgatttacaacacccacggttagatgaggtggcggaagaagttcccgttgcgctggtctacaacggcatttcgcacgtggtgatgatggcgtcgcccaaagaccttgagtactttgcgctcggtttttcgctttccgaaggaattatcgaaagcccgcgcgatatcttcggcatggatgtcgttccttcctgtaatggcctggaagtacaaattgagctttccagccgccgctttatggggttgaaggaacgccgccgggcgctggcgggacgtacgggctgtggcgtatgcggtgtagaacagcttaacgatatcggtaaaccggtgcagccgctgccgttcacccagacgtttgatctcaacaaactggatgatgcattacgtcatctcaatgatttccagccagtggggcaactgactggttgtactcacgccgctgcatggatgttgccatctggcgaactggtcggcgggcatgaagacgtgggtcgccatgtggcgctggacaaactgttaggccgccggtcacaagaaggggaaagctggcagcaaggtgcggtgctggtttccagccgtgccagttatgaaatggtgcaaaagtcggcgatgtgcggcgtagagattttgtttgcggtgtctgccgcgaccacacttgctgtagaagtggctgagcgctgtaatctgacgctggtgggcttttgtaaaccgggtcgggcaacggtttatacccatccgcagcgtttgagcaattaattaaaataagtcctgcgatatatattaaattacaggacttattcatttcgtgaattttgttattttttcataaacaaaacgcgtgtagtggcgttaacgcctgcgctgcaacctattgatggcgtggcggtgagttatattgatgctgccgtagcgttgggtaataccattaacgaaatggataaatattacacccaggaaaattataaagacgatgcgtttgtgaaagggaaaacattccactactactctctggcagtcatgatttcagcgaaacaaattaataacctgatatcgcaagataagtttgatgcagaagcggcaatgaagaaagtgtctgaactggaaacgctggtggcgcaagccaaagaagcggataaaagcggcatgaatttctcgtttattaattcggcaggccagtatcaactcgaggctaaaaaatacgttcgccgcatcagagataaagtcccgtactctgactgggataaagagcaacttcaggacgcaaactcaagctggatggccgaagactcatttccacgagcgttatgcgattacaacgaaatggtcgatgaaatatttcagtcaattgtaatcgcggggcgggtttgtgatgagcacggatatgtcacgaagtcgtaacaatataaagcagagtgaaggataaattttgtgaataaagtatcattatttaatgattttgtgaatgttaaaatgtctcagataatttgtttaagcgttatttatatttgtggcttatgagtcagcgtgaatcatatctaatattttttacgatatttagttaaaaacggcactattgttatattcctcacgttccaggaaatcagcggatttactcatattatgcggcgggatactatccatcggcctgctgaagttggattaaaaattcgaaagtgcacaccttatatttctctatatacgtattccttttggaaagcgtagggtctcctttatttcagggaacgtaaataatgaaaaaatcgacattatctttagccatcggtttattattggcatgtagtaccggtatggcaaaaacacagcatttaacgctggaacaacgcatggcattgctggaagaacgcctggaagcggcagaaatgcgggcagcaaaagcagaggggcaggttaaacagcttcagacacaacaagccgccgagatccgcgaaattaagaccgcacagggcaacacgccggtaaacggtcaatcaacgacggagtcagagaagaaaaacgccaccccgcctaatctcctgctttcagggtatggcgatttaaaaatctacggtgacgtcgaatttaatatggatgcggaaagtaatcatggcctgctggcaatgaccaacgctgatgtgaatagcgatcccactaatgaacagtggaatctcaatggtcgtattctgttaggttttgatggtatgcgaaaactggataatggctatttcgctgggttctccgcacaaccgctgggggatatgcacggttcagtaaatatcgatgatgcggttttcttctttggcaaagaaaacgactggaaggtcaaagtaggccgttttgaagcttacgatatgttcccgctgaatcaggatacctttgttgaacattccggtaatactgcgaacgatctttatgacgatggcagcggttatatctatatgatgaaagagggccgcgggcgttctaacgctggcggtaatttcctcgtcagcaaacaactcgataactggtattttgaattaaacacgttactggaagacggaacatctttatataacgacggtaattatcatggacgcgatatggaacagcagaaaaatgttgcttatctgcgtccggtaattgcctggtcgccgacggaagaattcaccgtttctgcagcgatggaagcgaacgtggtaaataatgcttatggttataccgatagcaagggtaattttgtcgatcagtccgatcgtaccggttatggcatgagcatgacctggaatggcctgaaaaccgatccggaaaatggcatcgtggttaatcttaataccgcctatttagatgctaataatgaaaaagatttcaccgctggaattaacgcgctgtggaaacgtttcgagctgggttatatctacgcacataataagattgatgaatttagtggcgtggtttgtgataacgattgctggattgatgatgaaggaacatacaacattcacaccattcatgcgtcttatcagttcgctaatgtgatggatatggagaactttaatatttacctcgggacgtattactccattctggatagcgacggcgataagatacacggcgacgatagtgatgaccgttacggcgcacgcgttcgctttaaatacttcttctgatgaaagggcggtgctggatattttccggcaccgcaactcattaaggcagataaaacacttcttgcagttcgctactgactgggctgttatccgcattagcgggcataacgtcggtcatatatttccaccaacgttggcaaacatctgtactggcaaccgcattccaccgctcttcagattcaatctctaccgtggcaaatagcagattatgcgctttgtcgagatagatggcgtagttatgcgcaccgtgagatttcagcactgcttccagttccggccagatgggattatgccgacgctgatactcttcgtgggcgtcggggtttacctgcatgacaaaggctttgcggatcatgtttgctccttacagcgccagcgcactggcgagtggtgtaacgccgaaacgctggccgagcgctatcaactcttcacggctgatggtctgtttcatgccgctcatcgaataaaccttcactaatatttgtgctgatttttctgcggtgtcgattaaaccgaaggtttcatccagtgtcggtccggaaccgaacacaccgtggaagggccacaacaccagcgaatgtttttgcatctcttgtgcagttgcctggccgatttcgtccgtgccgggtaccatccacggcagaatgccaacgccatccgggaataccaccagacactcggtgctgccttcccacagttggcgagtgaagaccgcggtgtcgttttccagcacgtaggtgagagcgatcaggttagtggcgtggcagtgcatgatcacccgatctttgccgttggtggctttaatgcgctcgaagtgggaaaggaagtgagctggaagttcggaagtggggacggcttcgttggttaacccccaaagaatgtggtagcccgcgccgtcgctgtcgacttttacgatgcctaagttagccgcaggatcaagctggacgttacggaagaatttgccggagccggtgacaataaacggtgtatttgccagtaaaggcatgggctggctgagcgggatatagcgcggttgttggtgaaaattgtcgtgatatggtgcgatatcggcgtcatccaggcgcagcgtcaggttgccgccgttgcgctcgtcccagcctttcagccaggcatcggtggtggctttgatcattccctggacaaaccaggactgggttatgttttgcatgttctgtgttcctgttaattggacgtccgtgcctgttgccggatgtacgatctgtaggccggataaggcacttgtgccgcatccggcaatcaatgcctgatgcgacgctgtcgcgtcttatcaggcctacaactattgccgacccgtaggccggatatggcgctcgtgccgcatccggcagtgtttacccgcggcgactcaaaatttctttctcataagtccgcacgttctccagccattcgctacccgctggcgtatcgtgacgctgacaatacatttcccataccgcctgccacggcaacgatttctgctcttccagtagcgccagacgcgcagtgtaatcgcccgccgcttccagcttgcgtagttcagcggtaggttccagcaacgcacgtagcagggcttttttcatattgcgtgtaccaatgacccacgcggcaatgcggttgatagaggcatcgaagaagtcgaggccgatatgcacctggtcgaacagatcgtgacgaacaatctcactggcaatcgcctgggtttcatcatccagcagcactacgtgatcgctgtcccagcgaaccggacggctgacgtgcagcagcaactgcggcacatacagcatggcggcggaaatcttgtcggaaatcacttcagtcgggtggaaatgcccggcgtccaggcacagcgctgtctggcggctggtggcataccccaggtaaaactcattggagccaaccgtgtagctctccgcgccaatgccaaacaatttgctctcaacggcgtcgatatggtgcgcagggtttagcttctcgctgatcacctcatccagtgctgccagcaaacgctggcgtggggcgagacggtcaacggtaatatctttcatgccatccgggatccagatgttcatcaccgacggtgtgccgagttgctcaccaaaataggctgaaacacggcggctggctttacagtggtcaatccagaactggcgaatgcggtcgtcggcatgggaaagcgtaaagccatcggcgcttagcggatgcgaaaaacaggaggggttaaaatccagaccgagctgattggctttcgcccattcaacccagtttttgaagtgctctggtttgatctggtcgcgcgagactggcgtgtctgattccagatagatggcatgtaaattaagccgtttcggccctggaatcagccgcatagcctgttccagatcggcacgtagctcactggcattacgcgctttgcccggataattaccagtagcctgaataccaccggtcagcaaaccttccgggttttcaaaaccggaaacatcatcgctctgccagcagtgcattgaaacgggtaaacgatcaagttggcgcagtgcctcctcgacatcaatccctactgccgcgaaacgctgtttcgccagctcccaggcctgttccagttgagtggtcatgcgcaaagctcctttgtctgtcgtgtagagtgaatctgcgccacatagtgggcaatttcactgtcaggattaggggtaaaggtggtcagattcgcggtagtgctgacgacctgacggaaatcatccacattgttgagttcatccagcgtcattaactggatgccgatattgccgagcgtcgaggcttcaacaggccctgcgatcacccgaataccgcaggcatcggcacacagctggttgagcagcgtgttctggcagccgccgccgacaatatgcagttgcgagaaatcttcaccacgcagctgcgccagctcatgcaacacatcggcatacagcagcgccagactgtcgaaaatacagcgcgccagttcagcatcactttccgggatcggttgcgccgtttcccgacacgcagcctgaatttcgctgcacatctcgtcaggattaataaagcgatcgtcattgggattgatgatgaagcggcaggccggaagtgcctgtgttgcggcgataagcgccggaagatcgttgatttgccgctcctgaagcactcgctgaagcagccataagcccataatatttttcagcacccgatagcgaccttccgccccgccttcattggtgatattggctgccagcgccgtgtcattggtaaatggcgtctggctttcgaagcccatcaatgaccaggtgccagaagagagataagcggcgcgtgaaccgtttaacggcgaggcgataaccgcgctggcggtatcatggctggcaacggcgaccaccggaatctcattaccctgcgggcaaatccagtgacctatgacattacccggatgcgtcgggcgaccaaaccaggctttgttggcaccgctccacgccagtagcgactcgtcccagtcgtcgctattgatattgaccagttgcgtggtcgtggcgttggtatattcccagttcatcttgccggtcaggcgataactaaagtaatccggtatcagcaaagcgtgagcaatgtgtggaataagttctggttgctgctctgtcagtgcacgtagctgatagatcgtattgaagggcagaaactggatgccgctacgttgataaatatcgcgtttgccgagttgttgttgtgcctgcgccattaggccattggtgcggctatcgcgataagcaacgggcaggcccacacgctgaccctgttggtcgagcagcacaaagtccacgccccaggtatcaatcccaatgctatcgatacgaatcccttcctcgcacaccttgtttaatccaaggcgaatggcactttccaggctatccacattccaggtgacataaccgttctggctatgcaggccattgttaaaacgatggatttcgcgcagcgtcaggctgcggcattcacgctcgtaacgcgccagcatcacgcgcccactggatgcgccgagatcgacggcgacacaattgcgaaaggtcataatgtgatcctgctgaatttcattacgaccagtctaaaaagcgcctgaattcgtgaccttctcgttactgacaggaaaatgggccattggcaaccagggaaagatgaacgtgatgatgttcacaatttgcttcattgtggtgatgtgatgctcaccgcattttctgaaaattcacgctgtatcttgaaaaatcgacgttttttacgtggttttccgtcgaaaatttaaggtaagaacctgacctcgtgattactatttcgccgtgttgacgacatcaggaggccagtatgaccgtattacatagtgtggatttttttccgtctggtaacgcgtccgtggcgatagaaccccggctcccgcaggcggattttcctgaacatcatcatgatttttatgaaattgtgattgtcgaacatggcacgggtattcatgtatttaatgggcagccctataccatcaccggtgggatggtctgtttcgtacgcgatcatgatcggcatctgtatgaacataccgataatctgtgtctgaccaatgtgctgtatcgctcgccggatcgatttcagtttctcgccgggctgaatcagttgctgccacaagagcaggatgggcagtatccgtctcactggcgcgttaaccacagcgtattgcagcaggtgcgacagctggttgcacagatggaacagcaggaaggggaaaatgatttaccctcgaccgccagtcgcgagatcttatttatgcaattattgctcttgctgcgtaaaagcagtttgcaggagaacctggaaaacagcgcatcacgtctcaacttgcttctggcctggctggaggaccattttgccgatgaggtgaattgggacgctgtggcggatcaattttctctttcattgcgtacgctgcatcgccagcttaagcagcaaacggggctgacgcctcagcgttacctgaaccgcctgcgactgatgaaagcccgacatctgctacgccacagcgaggccagcgttactgacatcgcctatcgctgcggattcagcgacagtaaccacttttcgacgctttttcgccgagagtttaactggtcaccgcgtgatattcgtcagggacgggatggttttctgcaataacgcgaatctcctcaacgtatttgtacgccatattgcgaataatcaacttcgttctctggccgaggtagccacggtggcgcatcagttaaaacttctcaaagatgatttttttgccagcgaccagcaggcagtcgctgtggctgaccgttatccgcaagatgtctttgccgaacatacacatgatttttgtgagctggtgattgtctggcgcggtaatggtctgcatgtactcaacgatcgcccttatcgcattacccgtggcgatctcttttatattcatgctaacgataaacactcctacgcttccgttaacgatctggttttgcagaatattatttattgcccggagcggctgaagctgaatcttgactggcagggagcgattccgggatttagcgccagcgcagggcaaccacactggcgcttaggtagcgtggggatggcgcaggcgcggcaggttatcggtcagcttgagcatgaaagtagtcagcatgtgtcgtttgctaacgaaatggctgagttgctgttcgggcagttggtgatgttgctgaatcgccatcgttacaccagtgattcgttgccgccaacatccagcgaaacgttgctggataagctgattacccggctggcggctagcctgaaaagtccctttgcgctggataaattttgtgatgaggcatcgtgcagtgagcgcgttttgcgtcagcaatttcgtcagcagactggaatgaccatcaatcaatatctgcgacaggtcagagtgtgtcatgcgcaatatctcctccagcatagccgcctgttaatcagtgatatttcgaccgaatgtggctttgaagatagtaactatttttcggtggtgtttacccgggaaaccgggatgacgcccagccagtggcgtcatctcaattcgcagaaagattaattcgccatgccgatgccgacgatgttagcggcgacaataatcaccacacaaccgaggctcaacaccgttaccggacggcgtcctgcattgttccactctttcagcaccagcccgacgataccgccgcacaatacatagaagctcatatgcagcatccagctgatgtagtcatactgcgccggaatgcgggcgtggccccaggcatagaaaaagaattgcagataccacatcaacccgcccagtgctgagagtaacacattgtgaatgatcagcggttttgccagcgagaagtcggcttttagcgacaaatctttcacttttgccagacgaatgaagcagaagccgaggttgatgattgcgccgccgcccatgatgacaacatagcttggcagagcgacatacaggggatcgacgcccagcgcggcagcggcttcatgcatcggttttgcggcgttcatcgcaaaggacatcccggcagagaaaatgccgcacatcaccgccagcaccagcccttttttcagattgaactcttcggctttaatgcccatcttgcgctctttcaactgcccggcgcgagttacaatccctacgccaatcagcgccaccagaacgccgagcaacgtcatgcgtccgccttcggtattaatcagcacatcgaaattgccgttgataattggcgtcatcagcgtaccgacaatcaacgtaatgccaatggcgatgccaattcccatcgacatgccgagataacgcatggtcaggccgtagttgatattaccgatcccccacatagcgccgaacagaaaaacaggcagcagcgtagagagactaaacgagctgtaatacgcccagaaattcggtagtaacagggcgctgatggcccacggcaggataatccacgaaacaatcccaccgactgaccacatggtttcccatgaccatttttttacttttttgaacggagcgtaaaaacaggctgcactggccgcgccgatcaaatgccaaaatatccccatcgtaatcgcgttactcatcttcttatcctcatcattttttcgtcgcgtcatatctccgacgagatgagtgtaaaaattgagctgtcgattaacctttcgcctgttgccgccgctgccgatttactggcaatcacggcattaagtgggtgatttgcttcacatcttgggcattttcctgcaaaaccatacccttatgaaaagtacggcattgataatcattttcaatatcatttaattaactataatgaaccaactgcttacgcggcattaacaatcggccgcccgacaacactggagatgaatatgagttataccctgccatccctgccgtatgcttacgatgccctggaaccgcacttcgataagcagaccatggaaatccaccacaccaaacaccatcagacttacgtcaacaacgccaacgcggcgctggaaaacctgccagaatttgccaacctgccggttgaagagctgatcaccaaactggaccagctgccagcagacaagaaaaccgtactgcgcaataacgctggtggtcacgctaaccacagtctgttctggaaaggtctgaaaaaaggcaccaccctgcagggtgacctgaaagcggctatcgaacgtgacttcggctccgttgataacttcaaagcagaatttgagaaagcggcagcttcccgctttggttccggctgggcatggctggtgcaaaaaggcgataaactggcggtggtttctactgctaaccaggactctccgctgatgggcgaagccatttctggtgcttccggcttcccgattgtgggcctggatgtgtgggaacatgcttactacctgaaattccagaaccgccgtccggactacattaaagagttctggaacgtggtgaactgggacgaagcagcggcacgtttcgcagcgaaaaaataatcatttgacgcctgctgcaatgaggcgtttacgccgcattgcagcttaaaaaatgaaccatcgccaacggcggtggtttttttgtgatcaatttcaaaataaaaacaatgatccgataaaaataaaacagcgtttcaattgatgtggttttgatcacttttattgatcaaatgaatgtctatcttcgtttccatcaacactgatgctccgttgaggaatgacgcatcagcccttaaaaatatgccgacaggtgatggaaatgcagataaaacgctcgattgagaaaatcccgggggggatgatgctcgtcccgctattccttggcgcactgtgccacaccttctcgccgggggcggggaaatattttggatcattcaccaacgggatgattaccggtacgctggtggtaactaaaattgccgtcgcgtgggtggttgcggcaattgcctcgcgcattattccggaacatggtgttgaagttggattttttgccggactttcaacgttggcgctggtggcggcgatggatatgaccaacggcggactttacgcttccatcatgcagcagtacggcacaaaagaagaagctggggcatttgtgttgatgtcgttggagtccgggccgctcatgacgatgattattctgggcactgccgggattgcctcgtttgaaccgcatgttttcgtcggcgcagtattgccgttcctggtgggctttgccctggggaaccttgaccctgagttacgagaatttttcagcaaagcggtgcagacgcttattccattctttgccttcgcactgggcaataccattgatttgactgtaattgcccagacaggtttgctggggatcctgttgggtgtggcagtaattatcgtgaccggtattccgttgattatcgccgataaattgattggcggtggcggtggcgatggcactgccggaattgccgcttccagttccgcaggggccgcggtagcgacacctgtgctgattgctgaaatggtgcctgcgtttaaacctatggctccggcagcaacttcgctggtcgcgacggcggtcattgtgacttcgattctggtgccaattcttacctctatctggtcacgtaaagtcaaagccagagcggcgaaaatcgaaattttaggtacggtgaaataaaccagcttccttaatccccacagccggatgaactaacgttcgtccggttttcaattgcgtttctgcctggatacttaccgcgaaaacaacacgcctgacataaaataaatatggtctaatagggaaatttctcgtggagagggaacagatgcgatatccggttgatgtatacacaggcaagattcaggcttatcccgaaggcaaacccagcgcaattgccaaaatccaggttgatggtgagttgatgctgacggacctggggctggaaggtgacgaacaggcggagaaaaagatccacggcgggccagacagagcgctgtgtcattatcctcgtgagcattatctctactgggcgcgggaatttccggaacaggcggagctgtttgttgcgcctgcgtttggcgaaaatctctcaaccgacggtctgacggaaagtaatgtttatattggtgatattttccgctggggagaggcattaattcaggtcagccagccacgctcaccttgctataaactcaattaccattttgatatcagcgatatagcgcagttgatgcaaaacacgggtaaagtggggtggttgtatagcgtaattgcaccagggttggtatctgctgatgcgccgctggagttggtttcccgtgtcagcgatgtgaccgtgcaggaggctgccgccatcgcatggcatatgccgtttgatgacgatcagtatcaccgtttactctccgccgcagggttatcgaaaagctggacgcgaacgatgcaaaagcgccgactgagcggcaagctcgaagatttttcccgccgtttgtggggaaagtaaccccggagtgtaggcctgataagacgctatcagcgtcgcatcaggcatcctgctcaaatgccggatgcggcgtaaacgccttatcctgcctacaaaacccataaattcaacaggttttgtaggcctgataagcgtagtgcatcaggcatttttttacctgaatgttgacgttatgaccgcttatacagcggcaaccaaatcaccagccgtaaaccgcccagcgggctgtcttctgccttcacccagccacgatgctgctgaatggcggtttctacaatcgccagccccaaacctgtaccgccagattcacgatcgcgtgcttcatcggtccgatagaatggacggaaaatctgttcgcgatcttccgggctaacgccaggaccatcgtcgtccaccgtaatggtgataccgtctttatctaccgcaaagcccacttcaatcttcgtatgggaataacgcagagcattacgaacaatgttttccagcgcactttccagggcgttcgggttgccgtacagcggccacggcccaggtgggaagttaaccgtcaacgacttgcccatttgctcggcttcgaacgccgcgttatccagcacttcactccacaactggttggctttgatggtctcgctaaccagcgcatttttctgctgattacgtgacatcaccaacagatcgttgatcatgctgtccagacgttgcgcttcagtttcaatacgctccagttccttgctttcaccgctacgacggcgcagtaacgccgtacccagttgcagacgcgtcagcggggtgcgcagttcgtgagagatatcagaaagtagacgctgctgagaggtcatcatgcgctccagcgcggtgaccatctggttaaaactggcaccggcggcaaggaattcctgtggccccgcttccagttccgggtgctggcgtaagtttccctgggcaacttcatcggcagcgtttttcagcttacgcgccggttttgccagactccaggccaaccacaacagcagcggcgtactgaccagcatggtgacaatcagcagtaatagcgggcggtcaaacagtaagttgatgaaatcggattgagaactgctggccggacgaatcagataaagttggtaattatcttcgccatcacgcacggagaacggaccgaccagttccacgcggccatactttttcttctgcggatgatcggcgttatcggcctgaccaataaagttacgaatgatctgcatttcgctgcgttcagcgccgatcacgcggccttcggtggtcaccagtaacaaacgctgtcctggcggtgcccacttatcaatcgcccggaacagacgccgccaccacattaaatcgttgggcggatcgttcgccagctccgcttcgacatgctgctcaatcatcagaccctgacgctgttcgctatccagaagctcggtcatctggcgtgaatcgagcttgggtaacatcaaaaccaacatcaacaccagcgccagcgtcagccagaagatggcgaagatgcgcgcggttaagctgcctatcatgaagcagaaaccatcagatagccgcgaccacgcagggttttaaaccacggatgaccatctttacgatccggcagtttacgacgcaggttggaaatgtgcatatcgatagcgcggtcgaaaggcgtcaggcgcttgcccagcacttcctggcttaaatgctcacgggaaaccacctgacccagatgctgtgccagcaaatagagcagggtaaactcagtaccggttaactccagcgtttgcccgtcgaagctggcttcctggcgaccaggattgagacttaaggcatcaacttccagtgtcggtgaaccgttgtcgttgttttgctgttgttcgctccagtgcgaacggcgcaggatcgcgcgaatacgtgccaccagctcacgatcattaaacggttttgggagatagtcatctgcgcccagctcaagcccgagaacgcgatcaagttcactgccgcgcgccgtcaacataatgacaggcgtctggtgtgtctggcgaagtgcttttaatgtgtcgataccatttttcttcggcatcattacatcaagcaaaagtaaatcaatgctgtcgtccagaagatcaagcgcctgttccccatcgtgggcaacaatcacgttgaagccttccatctcgagcagctcctttaatagggaagtcagctctcggtcatcatcaactaacaggattttattcattgtttaaatacctccgaggcagaaattacgtcatcagacgtcgctaatccatgactttacgttgttttacaccccctgacgcatgtttgcagcctgaatcgtaaactctctatcgttgaatcgcgacagaaagattttgggagcaaatgatgcgcatagttaccgctgccgtcatggcctcaacgctggcagtcagttcattaagccacgctgctgaagtcggttcaggcgataactggcatccgggtgaagaacttacgcagcgcagtacgcagagccatatgttcgacggcataagtttaaccgaacatcagcgtcagcagatgcgagatcttatgcaacaggcccggcacgaacagcctcctgttaatgttagcgaactggagacaatgcatcgccttgtcaccgcagaaaattttgatgaaaacgctgtgcgcgcacaggcagaaaaaatggcgaatgagcaaatagctcgtcaggttgagatggcaaaagtccgcaaccaaatgtatcgcctgttaacgccggagcagcaagcggttttaaacgagaaacatcaacaacgaatggagcagttgcgcgacgtgacgcaatggcaaaaaagttcatcgttgaagctattgagtagtagcaactcacgttcccagtagtaaaccctgttttccttgccatagacaccatccctgtcttcccccacatgatgtgggggttttttttatcctcaatttgcctgctgcttaatgcattgcagatgatttgcttccgttatactaccgtcagttgatagcgggagtatttatgaatcaatcttatggacggctggtcagtcgggcggcgattgctgcgacggcgatggcttcgctgctattgctgattaaaatttttgcatggtggtataccgggtcggtgagtattctcgccgcgctggtggattcgctggtggatatcggcgcgtcgttgacgaatttactggtggtgcgatattccctgcaacctgccgacgataatcactcgtttggtcacggtaaagctgagtccctcgcggcgctggcgcaaagtatgtttatctccggttcggcactattcctgtttttgacgggtattcaacatctggtatctccaacaccgatgacagatccaggcgtcggggttatcgtgacaattgtggcgctaatttgtacgattatccttgtctcgtttcagcgttgggtggtgcgccggacgcaaagccaggcggtgcgggctgatatgctacattaccagtctgatgttatgatgaacggcgcaattctgctggcgctggggttgtcctggtacggctggcatcgcgccgatgctctgtttgcattggggatcggcatctatattttatatagcgcgttacgcatgggatatgaggcggtacagtcattactggatcgcgcattgcctgatgaggaacggcaagaaattattgatatcgtgacttcctggccgggtgttagcggcgctcacgatcttcgcacgcggcagtcagggccgacccgctttattcagattcatttggaaatggaagactctctgcctttggttcaggcacatatggtggcggatcaggtagagcaggctattttacggcgttttccgggatcggatgtgattatccatcaggacccctgttccgtcgtacccagggagggtaaacggtctatgctttcataatcagtataaaagagagccagacccgcattttgtgtataaaataccgccatttggcctgacctgaatcaattcagcaggaagtgattgttatactatttgcacattcgttggatcacttcgatgtgcaagaagacttccggcaacagatttcattttgcattccaaagttcagaggtagtcatgattaagaaaatcggtgtgttgacaagcggcggtgatgcgccaggcatgaacgccgcaattcgcggggttgttcgttctgcgctgacagaaggtctggaagtaatgggcatttatgacggctatctgggtctgtatgaagaccgtatggtacagctagaccgttacagcgtttctgacatgatcaaccgtggtggtacgttcctcggttctgcgcgtttcccggaattccgcgacgagaacatccgcgccgtggctatcgaaaacctgaaaaaacgtgggatcgacgcgctggtggttatcggcggtgacggttcctacatgggtgcaatgcgtctgaccgaaatgggcttcccgtgcatcggcctgccgggcactatcgacaacgacatcaaaggcactgactacactatcggtttcttcactgcgctgagcaccgttgtagaagcgatcgaccgtctgcgtgacacctcttcttctcaccagcgtatttccgtggtggaagtgatgggccgttattgtggcgatctgacgttggctgcggctattgccggcggctgtgaattcgttgtggttccggaagttgaattcagccgtgaagacctggtaaacgaaatcaaagcgggtatcgcgaaaggtaaaaaacacgcgatcgtggcgattaccgaacatatgtgtgatgttgacgaactggcgcatttcatcgagaaagaaaccggtcgtgaaacccgcgcaactgtgctgggccacatccagcgcggtggttctccggtgccttacgaccgtattctggcttcccgtatgggcgcttacgctatcgatctgctgctggcaggttacggtggtcgttgcgtaggtatccagaacgaacagctggttcaccacgacatcatcgacgctatcgaaaacatgaagcgtccgttcaaaggcgactggctggactgcgcgaaaaaactgtattaatgatttcggaaaaaggcagattcctttagcctgaaaccgatgacagaagcaaaaaggcctgatgcgcttcgcttatcaggcctacatgaattctgtaatctattgaatttgcaaacttttgtaggcaggataaggcgtttgtgccgcatccggcatggacaaagcgcactttgtcagcaatatgaggcggatttcttctgcctttttaatcccccaacatatactcgcaagttatagccaatctttttttattctttaatgtttggtcaaccttctggcacgctttgctcatcacaacacaacataagagagtcgggcgatgaaaaagtggggcgtagggttaacatttttgctggcggcaaccagcgttatggcaaaggatattcagcttcttaacgtttcatatgatccaacgcgcgaattgtacgaacagtacaacaaggcattcagcgcccactggaaacagcaaactggcgataacgtggtgattcgtcagtcacacggtggttcaggcaaacaagcgacgtcggtaatcaacggtattgaagctgatgttgtcacgctggctctggcctatgacgtggacgcaattgcggaacgcgggcggattgataaagagtggatcaaacgtctaccggataactccgcgccgtacacttccaccattgttttcctggtacgtaagggtaatccgaagcagatccatgactggaacgatctgattaaaccgggtgtttcggtgatcacgcctaatccgaaaagctctggtggcgcgcgctggaattacctggcagcctggggctacgcgctgcatcacaacaacaacgatcaggcaaaagcacaggattttgttcgggcactgtataaaaacgtcgaagttctggattctggcgcgcgcggatccactaacacttttgtcgagcgcggaattggcgatgtactgattgcctgggaaaatgaagctctgctggcagcgaatgaactggggaaagataaattcgaaatcgtcacgccgagtgagtctatcctcgcagagccaaccgtgtcggtggtcgataaagtggtcgagaaaaaagacaccaaagaggtggcggaagcctacctgaaatatctctactcgccagaaggtcaggaaattgcagcgaaaaactactaccgtccgcgcgacgctgaggtagcgaaaaagtacgaaaatgcgtttccaaaattgaagttattcaccattgatgaagagttcggcggctggacgaaagcgcaaaaagagcattttgctaacggcggtacgttcgatcagatcagcaaacgctgatttccctaggataattatcaagcccggtggtttctcgccactgggttttttatttgtcacgattttgcgttacccttgcatctctttgaggtacagggaaaaaaagatgaaaaaagcgggtcttctttttttggtgatgatagttatcgccgttgtggctgccggtattggttactggaaattaaccggtgaagagtcagacacgttacgtaagattgttcttgagcaatgtttgcccaaccagcaggaaaaccaaaacccgtcgccatgtgcggaagtcaaacccaacgccggatacgtggttttaaaagatcgtcatggcccactgcaatatctgttgatgccaacgtaccgtattaacggtactgaaagcccattgttgaccgatccgtcaacgcctaattttttctggttagcctggcaggcgcgtgattttatgagccaaaaatacggccagcctgttcccgatcgcgcggtatctctggcgatcaactcccgcaccgggcgtacgcaaaaccattttcatattcatatttcttgtattcgtcctgatgtgcgcgaacagctggataacaatctggcgaacatcagtagccgctggttgccaatgccaggtggtttgcgtgggcatgagtacctggcgcgtcgggtaacggaaagcgaactggtacaacgcagcccatttatgatgctggcggaagaagtgcctgaggcgcgggaacatatgggaagctacgggctggcgatggtacggcagagtgataactcatttgtattgctggcgacacaacgaaatctactgacgctgaaccgtgcttcagccgaagaaatccaggatcatcagtgtgagattttgcgttaaggcgaggagtttaggaaagtaagtgccggatatgaaatccggcacctgtcagacttaagcctgtttagccgcttctgcagctttaacgatcacggcgaaagcgtcagctttcagagaagcaccgccaaccagcgcgccgtcgatgtctggctgagcaaacagttctgcagcgttagacgcgtttacagagccgccgtactgaatgatcacttgttcagcgatgttagcgtcaactttagcaatgtggtcacggatgaatttgtgaacagcctgtgcctgagccggagttgcagatttgccagtaccgattgcccatacaggttcgtaagcgataaccgcaccttcgaatgccgcagcaccctgagttttcagtaccgcgtcgatctgacgtgcacaaacttcttcagttttgcccgcttcgttttccgcttcggtttcaccgatgcacagaaccggagtcagtccctgctctttcagcaccgcgaattttttcgcgatcagttcgtcagattctttgtggtaagtacgacgttcagagtggccgatgatgatgtactgtgcgccgatgtctttcagcatagcagcagaggtttcaccggtgaatgcgccggacaggttcaggtccacgttttgcgcacccagcatgatgtggctgccttcagcttcacgcttcgccatatcgatgtacatttccggtggtgcgattgcaaccgcacagccagcaacacctgccagctctttacgcaggttagataccagctcgtgaaccatgtggcggctgccgttcagtttccagttacccatcactaaaggatgtcgcattttaattctccacgcttataagcgaataaaggaagatggccgccccgcagggcagcaggtctgtgaaacagtatagagattcatcggcacaaaggctttgctttttgtcatttattcaaaccttcaagcgattcagatagcgccagcttaatcggttcaacagcgaaggtcagccccttttcgccgttgtccgcgacaacataacgcagtgcaccttctgtctcggtgtaataacgtttgtttttccccgccgttagtagcgactgcagttttttctggctttgagttttggtcattaatggggtgagtgtgcggatcaccgctgccatgtatgcctgagctttcgctttcgcggctttttgctctggcccctggatgggtagccaggttatttgaatgcttttgatttttaaggtaccgcgctccagcgcagtagaagcatacaagttctcgttaattttacttgctgcacgagtgagattggctttgtcgggactgctgtcgatggcacgaaattcgttcagtggcaggctgggattctggctgttaaagtcttctcgaaactggctgatggagagatcgaaagtaggggctccagccagcagataaggcgcggtcgttgccgtatctggtgtttgtgcatgcgccgttgttgtaacggttaatgcagaacataagagaaaaaacagcgtacaccctggcttcattgacagtaccttttgttatgactggctccgattaaaacgatatctgtcgcccttgtcaaaagggtagaatcctggaaaagacaaccatcaaggaacttacatgaccatacagcaatggttattctcatttaaagggcgtattggacgccgtgatttctggatttggataggcctgtggttcgcaggcatgctggtgcttttctcactggcgggtaaaaatttactcgatattcagaccgcggcgttttgccttgtgtgcttgctttggccaacagcggcagtaaccgttaagcgcttgcatgatcgcgggcgttccggcgcatgggcatttctgatgattgtggcgtggatgctgctggcgggtaactgggcaattttaccgggtgtctggcaatgggcggtggggcgttttgtcccgacattgattctggtgatgatgcttatcgatcttggtgcgtttgttggcacacaaggcgaaaataaatatggtaaagatacccaggatgtgaagtataaagccgacaataaatcaagtaattaacctttaatatatctcttatcgctatttttttccgggattgttatttccacgatgcaagtgacaatgcccggaaaatccttctgaactcttcaccttaagcaatatcaaaaaaaatggtaatccataagatcattacttgtttgttcttcctttaacggcgcattattcttaagtcgtaatcgacagagaggcgaatatacagaggtgccctatgaaagatgtcgtagataaatgcagtactaaaggatgtgcgattgatatcggtacggtgattgataacgacaactgtaccagtaagttttcgcgcttttttgccacccgcgaagaagcagagtcctttatgaccaaactgaaagagcttgccgccgctgcatcctctgcagatgaaggggccagcgtggcctataagattaaggatctggaagggcaagttgagcttgatgcggccttcaccttctcatgccaggccgagatgattatttttgagttatcactgcgttcgttagcttgatggagttgctttagaaggagttaaatatggcttataaacacattggcgtggcaatttccgggaatgaagaagatgccttactggtgaataaagccctggagctcgccagacataatgacgctcacctgacgttaattcatattgatgatggcttaagcgagttgtatccgggtatctacttccctgcaacagaagatattcttcaattgttgaagaataagtcggataacaagctgtataaactgacgaaaaatattcaatggccgaagacaaaactgcgtattgaacgcggagaaatgccggaaacactgctggaaattatgcaaaaagagcagtgcgacctccttgtctgtggtcatcaccactcatttatcaaccgtttgatgccggcatatcgcgggatgatcaataagttgagtgcggatctcttgatcgtgccgtttatcgacaagtaaccgcttaccagtaatgctccgctgtcatatggcccggtcggcgacgtaaatgtttcgtcatctgccgggtctccttcagcaactgttgtgtatcgcgcaccatctgtggattgccgcacagcatcacatggctggtttctttattcatcggcaggccaaccgcgctttccagttcaccactttcaattaacgccggtaatcgcccagtgagcgaacccgcagccgtttcccgactgaccaccgtctgaatgcgcagtttcccctcgtagcgtttttccagttcctgcatcagaggtagatagcttaagtcggcggcatatcgtgcggcgtgaaccagcaccatgtttttgaagcgttctaaatctttgcccaattgcagaatcgataaataagggccaatcgctgtaccggttgccagcatccatagcgtttcgcaatctggtacttcatccagcacaaagaagccagcggcttcgctaaccacctgcacttcatcgcccggtttcagtgccgccagtcgtggacttaatttgccatcggggacggtgaccaggtaaaactccagatccggattatcgggcgagttaacataggagtaggcgcgctgaacgcgttcgccttcaatttcaaggccaagtttggtgaattgcccggcggtaaacggaagcacgggagcgtgaacggtgagactaaacagggcgtcggtccagttctgcactttagtgactttgcctgttacccaatcagccatgtttttctcctgttttgattgacttgccttatcttcgttctccgaacaaaaaaattccagtcccgaaggactggaaggctcaatcgatcaaatcaatcagaggatgtgcacctgcatttccgggtctttacgatccagatagtggatggactgaatgcgacgaatggtgcgtgatttaccacggatcagcagcgtttcggtggtggcgatattgcctttgcggctaataccttccagcagatcacctttggtgatgccggtggcagaaaagatgacgttgtcgctgcgcgccatatcgcccaaacgcaatactttaccggcttcgatgcccatcgctttgcagcgtgccagctcctgctcgccaatgcgacgattctcttcgttgtcgcctttgacgtcatgacgtgccagcagacgaccattcatgtcgccatctaatgcgcggatcaccgccgcagaaaccacgccttccggcgcgccgccaatgccgtacagtacatcgacttcactgtccggcatacaggtgagaattgaggccgccacatcgccatccggaatagcaaatacgcgtacgccgagttgttgcatttctgcgataacggcatcgtggcgcggttttgccagaatcgttaccgtcagttcgctcaacggtttgccgagcgccgccgcaacattgcgcaggttatccgccagcggcaggttcagatcaatggtgcctttggctcccggtccgacgatcagcttctccatatacatatctggcgcgttgaggaaacagcctttatcgcctactgccagcaccgccagcgcgttagcctggcccatcgccgtcatgcgcgtgccttcaatcggatcaacagcaatatctaccgcgtcgccgcgaccagtaccgactttttcaccaatgtagagcatcggtgcttcgtcgatttcaccttcaccaataacgatggtgccgtcaatgttgacctggttgagcataatacgcatggcgtttaccgccgcgccgtccgcggtgtttttatcgccgcgtcctaaccatttgtagccagccagcgctgctgattcggtgacgcgggaaaattcgatggcaagttctcgtctcatagcaaactctaagcagtaaggaatggcgcgaagtgtagcacaggggaagggcgggattattgatgtgtgcggggttgcccccgcacggtttcagagtctgtgtgatgccggatgtgtatccgactcgtaggcctgataagacgcgcaagcgtcgcatcaggcaatcattattactcgtcgtgttcttcccatgccatcgcgcgtttgatcgcttttttccagcctgcgtaacggtaattacgctcagtggtttcgatgccaggacggaactcgcgttcaatcaccgctttctcttgcagctcgtcaagattctgccagaagccaaccgccagaccagcaagataggccgcacccaaagcggtgacttcgcgcacttccgggcgctcaacgcgcgtaccgagaatatcggactggaactgcatcaggaaattgtttgctactgcgccgccatccacgcgcagggcgtgcagtcgaataccagagtcggcctgcattgcttccagcacgtcacgcgtctgataagcaatagactccagcgtcgcgcgtataatgtggttagcgttcaccccacgagtcagaccgaaaatcgccccgcgtgcatacggatcccagtatggcgcacccagcccggtaaaggccggaaccacatacacaccattggtgttttgcactttggtggcgaaatattcggaatcgtaggcgtcgttaatcaacttcatctcatcgcgcagccactgaatggacgcgcccgccataaacaccgcaccttccagcgcatagtttacttcgccagtcgggccgcaggcgatggtggtcagcaggccgttttctgatttcaccgctttctcgccagtgttcatcagcataaagcagccagtgccataggtgttcttcgccattccttctttcacgcacaactgaccaaacagcgccgcctgctggtcaccggcgatcccggagattggaatacgcgtgccgcctttgccgccaatgttagtctgaccgtatacttcggaagaacgacgcacttctggcagcatctcgcgtggaatatccagcacctccagcattttgtcgtcccagtccagagtatggatgttaaacaacatggtacgagaggcgttggtgtaatcggtcacatggacacggccctgagtcattttccagataagccacgtatcaaccgtaccaaacagcaattcaccacgacgcgcacgctcgcgagagccttctacatggtcgaggatccacttcactttggtgccagagaagtacgggtcaatcaccagaccggtgttgttacgaatgtactcttccatgccatcgcgtttgagatgttcgcagatctcggcggtacgacggcactgccagacaatggcgttatagataggcttgccggtttctttttcccagacaatagtggtttcacgctggttcgtaataccgatagctgcaatttgatcggaactgatatcggctttcgccagcacttctaccagcgtggagctttgggtggcccagatttccattgggtcgtgttctacccagcctggttttgggtagatttgctcaaattcgcgctgcgacacgctaatgatattggcatcgtgatccattacgaccgcgcgggagctggtggtgccctggtcgagcgcaacgatatattttttttcagtcatgtttaattgtcccgtagtcatattacagcgaagctttttgttctgaaggagttgtggtctccttttcttccacaacacagatatcgcaaggcaaatggcgaccaatcagtttgcgataggcaaatgcacctacaatcgcgccaacgatagggccaaaaagcggcaccaggaagtaaggaatgtctctgccgccggtaaaggcgacattgccccagcccgccagccaggcaaagactttcggaccgaagtcacgcgctgggttcatggcaaagcccgtcaatgggcccatagatgcgccaatgaccgcaatcagtagaccaatcagcaagggagccaaagggccgcgtggtacaccgttgccatcgtccgttaacgccaggatcagccccatcagaatagcggtaatcaccatctcaactgcgaaagcctgcacaaaattgatatgaggattagggtaagtagagaaagtgccagccagatcaacactttcaacgctgccgcgaacaatgtgatgagtctgctcgaagtcgaaaaataaattgtagtaaagcccgtaaactaaagccgcagcacagaaagcgccggcaacttgtgaaacgataaaaggaataactttgcgcttgtcgaaacaggcaaacagccacaatgcaatggtaacagcgggattaagatgcgcgccggaaacccctgcggtcaggtagatggccattgccacccccagtccccaaatgacactgatttcccactgaccaaaagacgcaccagcgacttttagtgctgcaacgcaacccacaccgaaaaaaatcaacaacccggtaccgaggaattcagcaatgcactggcctttcaaggttgatgtttgactcataatcggatcctgaagagttaatgtttgttgtatgcgtgaaagtcacggacctccacgatgcttgtaagcatgctgtaaacttatcgttaacgagcaaaaacgagaaatatcgaacttaaaatgtgtgtgcttcgtcataaaatgagcgttatcgcgccatttattccatctgattgtacatgatgcatgtttgttagatcattcgcgcaacaaatttattaacattttcgattggtgtggattatgtcaccaggagaaggatgaaaagtgtagcaaaccgtaatctgcaaggcgtgccgctggacagcgatggcgcggcttcatacaatcggagctaactaaagtgcgctcgtatttattaaggcgtcaccggtaatcgggacgaggatttttatccatcaacgccttgcaattcaggagaggtatgacaatgtcattagaagtgtttgagaaactggaagcaaaagtacagcaggcgattgataccatcactctgttgcagatggaaatcgaagagctgaaagaaaaaaacaactcactgtcgcaggaagttcaaaatgcccagcatcagcgcgaagagctggagcgtgagaacaaccatctgaaagaacagcagaacggctggcaggaacgtctacaggccctgctgggtcgcatggaagaggtctgattacacttcatctttcgcgtaatttctttactgtgtaggccaacaggtaacgcagaaaaaaggcaccttgcggtgccttttttatcattcaatatccagcggatcttctgaaagaataatcccggtattgtcggcataaagatggtcgccggagaagaaggtgacaccgccaaaattgacgcggacatcgctttcgccaatgccttcgccagcggcaccaaccggaattgccgccatcgcctggatgccgatatccaactcttccaggtcatctacctgacgcaccgcgccgtaaatgaccagaccttcccattcattttgtactgccagacgcgccagttcagcatcgaccagtgcgcgacgaacagaacctccgccatcgacgacaagaacacgaccacggccattctgttcgagcagatcgtacagcaacccgttgtcctcgaaacattttaccgtgattatttgtccgccaaacgacgcccgtccgccaaagttggagaacagcggttccacgacgttaacatcttcttgatagatgtcacaaagctcggaagtatcgtatttcataggcttaacattcagttgctgcgagaattttcagtatatcgcgctatgtgggctgttggcaaaatcatcaattgttaattgatatttgtcagttatgctgcccactggcttaggaatatccctaaaacaaacagcaggttagtcagtaacgctcctttgacagtgcgttccagcattggtcgcatcgccaccgggtccatttcgcgcatcacataacgagcttgcttcaccagcaacggtgccgccagcaggaacagccagccccacaggctatgcagcgaaaagagattaaacagcgccagacacaccagagagcccatcagcaggcaggcatgataacgacgcgcgtttactgcgcctaagcgcaccaccagcgtgtttttgccgttttcgcggtcgctattgatatcacgcaggttattaatgttcagtactgccgttgccagcaggccgcatgcggttgccggaaggatcagtgccggaatcaatgtatgagcctgtaaataccagctccccatgacgctcaaccagccaaagaaaaccagtacggaaatatcacccaaaccgatataaccataaggacgattgcccacggtgtaggtgatagcggcaatgatcgacaacccaccaagaatcaggaaaccgacaaaatcggccagcgtatggcacgccactgcaaccagtgccagcccggaaagacagatgagcacaacggtaataatgagcgcccgtttcatctcttgctgggtaatgacccctttttgcatgccgcgtagcggcccaatgcggtcaggtttatcgctgccttttaccgcatcgccgtaatcattggcgaggttagaaaggatctgtaatagcccggcggtaatcaatgccagcagggcgaccagtggatcgaagtgaccttgccaccatgccagcgccgtcccgacgataattgcagcaaaggcgagggggagggttttaggtcgtaaactttccagccacgcctgagttcggctaatttgttgttcagtcataatacgcgccaataaaaatggggcctttcagccccatcaaacaatgatgaaaatgattgaacgcgattataggataaaacggctcagatcttcatctgccaccaacgcatccagatgtttgctcacataatctgcgtcaatagtgatagtttgaccgcttaaatcgctggcgtcgtaggaaatctcttccattaaacgctccagaacggtatgtaaacgacgagcaccgatgttttcggtagattcgttcacctgccatgccgcttccgcgatgcgcttaataccggagtcggtaaactcgatatttacgccttcagttgccatcagtgctttgtactgcacagtgatagaggcattcggctcggtcagaatacgctcgaagtcgctggtggtcagtgcctgcagctcaacgcggattggcagacgaccttgcagttccgggatcaggtcagacggtttcgcaatctggaacgcgccagaagcgataaacagaatgtggtcagttttgaccatcccgtgtttggtggaaacagtgcaaccttctaccagcggcagcaggtcacgctgaacgccttcacgagaaacatccggaccggaagactcgccgcgcttacagattttgtcgatttcgtcgataaacacgatcccgtgctgctcaacagcgtcgatagcatcttgcttcagctcttccgggttcaccagtttcgccgcttcttcttcaatcagcagcttcatggcgtctttgattttcagcttacgcgctttttgcttctgaccgcccaggttctggaacatggactgcagctggctggtcatctcttccatgcccggaggagccataatttcaacgcccatcggtgctgcggcaagatcgatctcgatttctttgtcatcaagctggccttcacgcagttttttgcggaatgcctgacgagcagcggacggttcctgctgctgttcggtctgtccccagttgtttttagcaggtgggatcagcacgtcgagaatacgttcttctgccagttcttcagcgcgataacggtttttctcgatagcctggacgcgtaccattttcacggcggcatcggtcagatcgcgaataatagaatccacttccttaccgacatagcccacttcggtgaatttggtcgcttcaactttgatgaacggcgcattcgccagcttagccagacgacgggcgatttcagttttaccgacaccggtcgggccgatcatcaggatatttttcggggtcacttcatggcgcagctcttcgttgagctgcatgcgacgccagcggttacgcagagcaatcgccacggaacgcttggcgttgtcctggccgatgatgtgcttatccagttcgctgacgatttcgcgtggggtcatttcagacatgggagatccttacgctttgtagcttaattcttcgatggtgtggaaatggttggtatagatgcaaatgtcgcctgcaatatccaacgccttttcagcaatttcacgggcgctaagttcagtattttctaacagcgcgcgcgccgcagcctgggcgtaagggccgccggagccgatagcaataagatcgttttctggctgcaccacgtcaccgttaccggtgatgataagcgatgcagtttcatccgcgactgccagcaatgcttcaagtttgcgcagcatgcgatcggtacgccagtctttcgccagctcaacggcggctttgatcagatggccctgatgcatttccagtttacgttcaaacagttcgaacagcgtaaaagcatccgcagtaccgcccgcaaagcccgcgatgactttgtcgttgtacagacggcggacctttttcacgttgcctttcattacggtattgcccaacgtggcctgaccatcaccagcgatgaccacatggccgttacggcgtacgcttactatagttgtcacgagctgaccccttggttacgaatacagagtacaaaccccgtacaaaagtacggggcataatgtaattatagatgggggggattttgagggtttcaacccccggcggcgagccgaatgcagtttgtatgacccgccatcttcaagcgattgagggtgctgtctgcgttctctttgcctttcaccgggccaatcaccacacgattccagccattgttggtggtaatttttgagtcaaagccttcgaacgccagctgagcacgtaccgtctctgcctgttccgcgcctctgaacgaaccgcactgcaccatccagcggcgttcgtcttttttctccgccgtcggttttggcgcgtcagcggcacgagcaaccggcgcagcttgctgcggcttcgactgcgcggtcgtgtgcgcaggggtttgcagcagatcctggtaaggctgctgagtagaagccggtttagactggcgcggttgcgcctgtaccggtgcggcttgcgacgtacgcgtctgctgctgccagctttgttcagtcgtacgcgactgctgagccaggcgttgctgctccgctaattgctgcgcctgacgctggcgctgtagcgtttgctgacgctgttccggcgtctgctcattccacggaacttcaaccagctgcgttggctgctggcgcatatcagcctgcatttgttcaagaagctgacgttgttctggtgtcagttgctccggcgttttcacttcaccaccagcagaaggttctgtgggcgcacgcatacccggctggcgactttccagctctttgatgtagcgccagcgttcttctggttttggtggtagtccgtttccggtcactttctggctttgcagcgtctcggactcttctttcttgtgatgcgtaatgaagtacagaccaccgataaaggtcacaagaacggcggcagcaatagcgaccatagcgggagaaaccgcaggcagatttcgttgctttttccgtgaggtgctcttttttcgccgcgaaggtgccggttggctgcggcgtacataatctcgttgtgccactatcgtttcgctgtatttattcgttcgtcagcccgccatgttacttaagcggcgggcctttgaccagtcacggcagtcttaaaggtttactttaaggtaacgcgcgtgttgatccccggatgataagttcgcagtccattaaacgagagccactgccaacgtgttgcccctgcatttgatcaagcaataacagcatagcttcccgaccgatttcgtaacgcggctgcgcgatggttgtcagcggcggatcacaaaattgcgtcaggtcgatgttatcaaaaccgattatggaaaggtcttccgggactttcagcccctggcgttttgcctgagaaagtgcgccgagcgccatcacatcgctatggcagaagacagcagtaggcggttgtggaagatcaagcaactgctgcatcgctttgcttccggcttcgaaggtgaagtcgccacgggcgatgtattgcggatcaaccataatgccgcagcgacgcagcgcctgaaagtagccttgcaggcggtagtgacacagcggcatctcttcaggaccggctatacagccaatccgtttatgcccttgctcatatagataatttactgcatcaaatgcggcggtcagattgtctatatgaactgtaggtagctccagttccggtgcaaattcgttcgccatcaccatcggcggcagattacgctgttcctcaatgctggcatcaaacggcagccttgaacccagcagcaacatgccatcaatttgcttggtgatgatcaaatcgataaaggttttttcctgctgattttgatgcgcacagtcgccaatcagcaccagatatccgtgatttgccgccgtaacttcgataccgcgaataatttcgctaaagaaagggtcgcagatatccgggacaatcaccagaatagtgcgggattcattacgcttgacgttgcgccccataggctgtggtaaataacccacttcccgggccgctttttcaacccgattacgagtggcctgggagactttatcgggattcattaatgctcgggagacggtcgctgtagagacttttgccttgagggcaacgtctttcatggtcgcggcagtttcctgcttcttcgctttcacactcactcctcgcctggcacgtcaggcgtactacatccatgtttacttcacatcggcaacatttttagcagatagcgcgtgaaaacggttacagaattttcatgaaaagtgtgatgaatattgaatttttcgatccgcctcgcatcgtgagcggtttaaccctcaatcggatcgacatccagcacccatttcaccttgcgggaatccggtattgtattaataagcgccagcgtaccattgatgatgtgctgtaagcgcacgcgggaagggtgctgcaacaatatctgccagcgccagcgaccgccacgtttaggggccagcgccggaaccggaccgagaacccacagtttctcgtctgccagtgggctggcgagaatgagattacgcagttgttgcaggaacaatggcgcgtgctgattgttatgatcttccgcacgcacaatcacatggctggtccacggcggcagctgcatcatgcgtcgttcagccagtgcctgttcggcaaaggcgtcgtagcctttataaagcaacgtttgcaacagcggatgttcaggatggtgcgtttgcagaactacttcgccctgtttacccgcacgcccggcacggcctgccacctgggtataaagctgggcaaaacgctctgccgagcggaaatcggcagaaaacagcgcgccgtccacatccagtaacgccaccagcgtcacatccggaaagtggtgacctttcgccagcatttgcgtaccgatcaatatccgtgagccaccgcgatgtacttccgccagttgttgttccagcgcgcctttgcggctggtggtatcgcggtcgatacgagaaatggggacaccagggaacaacggcgcgagcgtctgttcaagctgttcggtgcccagccccacgggtaccaggtgcgtggaaccgcaagaagggcactggcgcggcaccggacgctgactgtcgcaatggtggcagcgcaaatgctgttgcgcctgatgcagcgtgtagtagtgatcgcaacgtgggcattcggctatccaaccacagtcgtggcacagtagcgcaggcgcaaaaccccggcggttaagaaagaggataacctggttgtcggcctgtaaatgctggcgcatacgggtgattaacgccggagccagacctgcctgcactttctggccttttaaatccagcacatgttgaattgccgggcgcgcattccccgcccgacgggtcaggcgcagcaggcggtattttttctgctgcacgttgcataacgtttccagtgcgggagttgcggagccaagaataattgggatttgctcgctatgcgcgcgatacaccgccaggtcgcgggcatggtagcgccagccttcctgctgtttataggaactgtcgtgctcttcatcaatgacaatcacgccgagatttttaaacggtgtaaacagcgcggagcgggtgccgatcacaatcgccgcctcgccatttttcgctttcaaccacgccgaaagacgctcgctgtcgttcaggccggaatgcagaacttccacgggggcattaaaacgttcacgaaaacgggcgatagtttgcggtgtcaggctgatttccggcaccatcaccagcgcctgtttgccctgagcgagcacgttttccagtacactgagataaacctccgttttaccggaaccagtaacgcccgccagcagccaggcagaaaaagtatctgccgcgctatgaattgcgccaacggcggtggcctgttcggtattcaaccgcaaccgctcaccagaaacggcatagttcgttcgccagtcgctaaactctggtgtttcacttgctaaatcacacagaccttttttgcgcagtgcctgcaacgcggcatcattaaattcaagttccgcgacctgatcacgccatattttgcgttgccgtaacgctgccagcgcctgttgttgctttggcgaacgtttcaggctgttcagatccaccgcctgaccttgttcagtggcaaaccagtaccacatcggcgcgttcgccgcaggccgcccctggcgcagtaaaatcggcaaggcatgaaacagcacatcgccaatcggatgatgatagtaatctgccgcccagagcagtaatcgccagacagagtgagtaaataccggctcaacgtccagcacttcaactaccgctttcagctcgttaagcggcagctcactgacatcgctcactgacaccacaacaccgatacgctcctgttgtttgccaaacggcacgcgcacgcgactcccggctttaaccgtcatgccttctggcagcagatagtcaaaggtacgaggaagcggaacgggcaaggcaacgtgggcaacgggcatagcatcatcctgacttgaaattcggtgggttagtatacacattgccgtagaagagtgcggatcagtttgcatacgctggttaatttctgtatgatttcgcgccttcgtacgaaatgatcgtattgaagctatacttttaacatcgcgtggtgtctggcgttagggctggaagagcgacgcggccttaaaccgaggttttcccatgaaaaaagatattcacccgaaatacgaagaaattactgctagctgctcttgcggtaacgtaatgaaaatccgctccaccgttggtcatgacctgaacctcgacgtgtgcagcaagtgccacccgttcttcactggcaaacagcgtgatgttgctaccggtggccgtgttgaccgcttcaacaagcgtttcaacatcccgggcagcaaataagaccggatttccgaaaaaagcgccgtacggcgctttttttgtgcctgaatgttggtcgtattaccaggaaaacagcggccattctttggcgaccgtggtgagttgtggcgcgtcgaaaacggcttgtggtgaaactaccgtttcctcaagcggaatatttttgccgtagcgttctttgagctttgcctgaactagcgggttactaagatcgaactctttcagcttctgctgctcgcccacacgcattcccagcgcattctggtagaccttccacaccacttccgaacagtactggcgatcgtcgctccacgagaagctggagtcatacggtttaccgagataacgttttgccgtttgcgccagtttttgctgttgttcaacactcagtccgccttcaacgcggcgaacaacgtatttgcccttttcaccatgggcgatccactgcttgagtggggtgtattttaccgggccgaccgcttcaaaaacgtagggctttttgttgcgtatcaccagcataccggtgtggctgtaatcggaatgggtcgccagttggatcgctttactttgcgatgagcgagagatctgaaagatgatgtcgccggtttgtggttgccaggcaaatgcaggcacagaaaccagcaggctgagaatcagtagcctgattttcatcgttaaacgtccatgtatgaaaaaagcggctggttaactccgcgccgctcttttccgctttagtattcccacgtctccgggttaatccccatctcacgcatgatctcttttgccgcctccggaatttcgtcgctgcgctctttacgcaggtcggcatcatccggcaaaggttgcccggtaaaggcatgcagaaacgcttcgcacagcagctcgctgttggtcgcgtgacgcaggttgttcacctgacgacgcgtgcgttcatcggtgaggatttttaacaccttaagaggaatggaaaccgtaatttttttgacttgttcactcttcttgccgtgctcagcgtatgggctgatatattcgccgctccattcagccatgagatacttaatcctcttcgtcaataaattgaggccagaccacacaattaatatgggtactgaccgtaaacccgcatagtttaccgtacaggcgttaccgtgacatcgtgtaatgcacctgtcggcgtgataatgcatataattttaacggctatttgagatttgctcaatctatacgcaaagaagtttagatgtccagatgtattgacgtccattaacacaatgtttactctggtgcctgacatttcaccgaccaagcccagggaacttcatcacatgacgcgtaaacaggccaccatcgcagtgcgtagcgggttaaatgacgacgaacagtatggttgcgttgtccctcccatccatctttccagtacctataactttaccggatttaatgaaccgcgcgcgcatgattactcgcggcgcggcaacccaacgcgcgatgtggttcagcgagcgctggcagaactggaaggcggtgctggtgcagtacttactaataccggcatgtccgcgattcacctggtaacgaccgtctttttgaaacctggcgatctgctggttgcgccgcacgactgctacggcggtagctatcgcctgttcgacagcctggcgaaacgcggttgctatcgcgtgttgtttgttgatcaaagcgatgaacaggcattacgggcagcgctggcagaaaaccccaaactggtactggtagaaagcccaagtaatccattgttacgcgtcgtggatattgcgaaaatctgccatctggcaagggaagtcggggcggtgagcgtggtggataacaccttcttaagcccggcattacaaaatccactggcattaggtgccgatctggtgttgcattcatgcacgaaatatctgaacggtcactctgacgtggtggcaggcgtagtgattgctaaagacccggacgttgtcactgaacttgcctggtgggcaaacaatattggcgtgacgggcggcgcgtttgacagctatctgctgctgcgcgggttgcgaacgctggtgccgcgaatggagctggcccagcgcaacgcgcaggcgattgtgaaatatctgcaaacccagccgttggtgaaaaaactgtatcacccgtcgctgccggaaaatcaggggcatgaaattgccgcgcgccagcaaaaaggctttggcgcaatgttgagttttgaactggatggcgatgagcagacgctgcgtcgtttcctgggcgggctgtcgttgtttacgctggcggaatcattagggggagtggaaagtttaatctctcacgccgcaaccatgacacatgcaggcatggcaccagaagcgcgtgctgccgccgggatctccgagacgctgctgcgtatctccaccggtattgaagatggcgaagatttaattgccgacctggaaaatggcttccgggctgcaaacaaggggtaaaaatgagtgtgattgcgcaggcaggggcgaaaggtcgtcaactgcataaatttggtggcagtagtctggctgatgtgaagtgttatttgcgtgtcgcgggcattatggcggagtactctcagcctgacgatatgatggtggtttccgccgccggtagcaccactaaccagttgattaactggttgaaactaagccagaccgatcgtctctctgcgcatcaggttcaacaaacattacgtcgttatcagtgcgatctgattagcggcctgctacccgccgaagaagccgataacctcattagcgcttttgtcagcgatcttgagcacctggcggcgttgctcgacagcggtattaacgatgcggtgtatgcggaagtggtgggccacggtgaagtgtggtcggcgcgcctgatgtctgcggtgcttaatcaacaagggctgccagcggcctggcttgatgcccgcgagtttttacgcgctgaacgcgctgcgcaaccgcaggttgatgaagggctttcgtacccgttgctgcaacagctactggtacaacatccgggcaaacgtctggtggtgaccgggtttatcagccgtaacaacgccggtgaaacggtgctgcttgggcgtaacggttccgactattccgcgacacaaatcggtgcgctggcgggtgtttctcgcgtaaccatctggagtgacgtcgccggggtatatagcgccgacccgcgtaaagtgaaagatgcctgcctgctgccgttgctgcgtctggatgaagccagcgaactggcgcgtctggcggctcccgttcttcatgcccgtactttacagcccgtttctggcagcgaaatcgacctgcaactgcgctgtagctacacgccggatcaaggttccacgcgcattgaacgcgtgctggcctccggtactggtgcgcgtattgtcaccagccatgatgatgtctgcttgattgagtttcaggtgcccgccagccaggatttcaaactggcgcataaagagatcgaccagatcctgaaacgtgctcaggtgcgcccactggcggttggcgtgcataacgatcgccagttgctgcaattttgctacacctcagaagtggccgacagtgcgctgaaaatcctcgacgaagcgggattacctggcgaactgcgcctgcgtcaggggctggcgctggtggcgatggttggggcgggcgtcacccgtaacccgctgcattgccaccgcttctggcagcaactgaaaggccagccggtcgaatttacctggcagtccgatgatggcatcagcctggtggcagtactgcgcaccggcccgaccgaaagcctgattcaggggctgcatcagtccgtcttccgtgcggaaaaacgcatcggcctggtgttgttcggcaagggcaatatcggttcccgctggctggaactgttcgcccgtgagcagagtacgctttcggcacgtaccggctttgaatttgtgctggcaggcgtggtggacagccgccgtagcctgttgagctatgacggtctggacgccagccgcgcgttagccttcttcaacgatgaagcagtcgagcaggatgaagagtcgctgttcctgtggatgcgcgcccatccgtatgatgatttagtggtgctggacgttaccgccagccagcagctcgctgaccagtatcttgatttcgccagccacggtttccacgtcatcagtgccaacaaactggcaggagcgagcgacagcaataaatatcgccagatccacgacgccttcgaaaaaaccgggcgtcactggctgtacaatgccactgtcggtgcgggtttgccgatcaaccataccgtgcgcgatctgatcgacagcggcgataccattttgtcgatcagtgggatcttctccggcacgctctcctggctgttcctgcaattcgacggtagcgtgccgtttaccgaactggtggatcaggcgtggcagcagggcttaaccgaacctgacccgcgtgatgacctttccggcaaagacgtaatgcgcaagctggtgattctggcgcgtgaagcgggttacaacattgaaccggaccaggtacgtgttgaatcactggtacctgcccattgcgaaggcggcagcatcgaccatttctttgaaaatggcgatgaacttaatgagcagatggtgcaacgactggaagcggcccgcgaaatggggctggtgctgcgctacgtggcgcgtttcgatgccaacggcaaagcgcgtgtgggcgtggaagcggtgcgtgaagaccatccgctggcatcactactgccatgcgataacgtctttgccatcgaaagccgctggtatcgcgacaacccgctggtgatccgcgggccaggtgcagggcgcgacgtcaccgccggggcgattcagtcggatattaaccggctggcgcagttgttgtagtgattattgaacaaaagctggcagttgccagcttttgttgtcaccccgaaacctcttcctggggaagtggtgattgattgtcattttgcctttggtcagtgcccccggtaataagggggcttttgtgttgagcgatgaagtaacagagtgaatggtgaagttattaatgacaattacaaaatgacattaagtaacaatatctaaaatgtcacctaatttaaaattgataaccaatagtagtataggttccccatcctgtattttttaattcaaatggaccatctccgaagttaaccttctctcccgcattccattgtccaccgttgtgaaaataacgtagtgtaaatgcaaatttccagtgttcatatagaagggaaaggatatggcttgaagcaatagcattactggttcgtttattattgtgtgacttgtccgcaagatcggagccaaaatcaaagttagtaaaactattgtataccaatcgccctccgaataaatttgtaagagggatgctatattttattttgaatcgatatccgtcccattcattttcattagcggcaccatagttttgccactgatacttggcgtatatattggcagaaagcttaattggtagacccgtgtcgatatctgtaccaagccccatataccatgtactttgccgggatgactggttgtcacccatatcatagacatagttgtttgcaatgaaccattctttaaatgggccgaacgcaagatttaatccggtcaatttgtcaatggaaaaccgaggttctatttccgtaaatagtggtgagccctcatcccagatcccaacatcatagtgactgccgacgccaaagaatttcggtagatcaacataaccataaaaatcaaaccagtcttttcttcctgctacagtatattcagggtagaggtcgttagtcagtcttgggccaaagcgagagtctgtgcgaccaatgacattcaagctttgatgtaaccagctttcatcaattttaatttcctgagcgtttccaatgcaaggtattaatagaatggataaagctatccagtgcttttttatatacataaatatatctcttatatattgttgatttagagagaaataatgtcatccagtgaatgaatggtattataagtttttgttatttgcttacttctacccgcatttcatttacctgtgcaggagtaatcttgtggcctttcttaaaataatcgattacgacattggacatgttatttccggcgcggacctggacatttttcccttctttgaatgccagaaaaccatcgcccccaagtgctaggaaagtcgtagtcgcaacatggtaaatattcgtatcaacgatctcttcaccattaattttaaaagatacaatgcgctgacctactggtttctgcagggtatagcgcatttctgcgccttttgacatttgcaggatgccattggtaagcgatgccccgtgctccagtaggttacgcagatccttaccgctgagatccatttcagtaagttcattcttgaaggggaatgtactggtaatgtcaccaaaggtaatcgtgcctgcatttatatcagcacgtaaactgccggagtttatcaacgcaatttgtgcagtcggtgcagcgacaagcattgcatcggtaaacaggttgccaagttgcgatgactcaccgtaggcacgagttaatgcaatcgatgattcaccgactggttggcgtacaatatccaccagttttttattccagccattgataactttttgtgtggttggatcgggtatccattcatcggcataaaccgttttcagctcaaagctcttcactttatgagtacgagctgtagggttgacatcaaggattaatttaccaatatcgataccgccactgtcagtcgaaaggattaaggtgttgccgactttgattggttctggcgttccgacgtgggcatgcccggtaatcagaatatccaatcctttcaccttgcttgcggtttgaatatctttatccagcgcacgtctaacatctgtattgccaatgctggactgacgcgccggtacgccttcatgaaccagcgccacggtgaggtcaaccttatcacgtaactcgtcgatataatgctgcaaatacttcacttcatcacgtgcttcaatcccctgattcttgagggtcgcggaagatttatcaaatcggttattattgtcattatcgagtccctggagagagagctccgagacagtgtcattaaatgcaaatacgccgtgtagcccaacaataccaatcttgatgccatctttttccaggatggtgtagggcttgttccagaagggtttctcactctctttatgataaacattgcctaataaaacagggaaattcgctttgcttaattgtcggagggcattatcccagccatggtcaaactcatgattaccgattgatactgcgtcaaaaggcatggtattcataatatcaattattgcttcgccctttgtcaggctactgatatatggcccggtgaaatagtctccagcatcaaaataaaaggtggctttatttttggctttctcttgttttactaacgtggatatattggcaaagccaccaatgtcgcgttttccggtattatcgatattatgaatactatgccgtttgatgctgtcacaataggcaaccatgaatttgaccacggctgggacaacacattattacagttgagccaggcaaaattccctattgtgcagggcaatattttttatcagaacagcagtaaatcattctgggataagccctataccatcatcgaaaaagacggcgtgaaaattggcgttataggtttgcacggagtatttgccttcaatgatacggtatctgctgccacgcgcgtgggtattgaagcgcgcgatgaaattaaatggctacaacgttatatcgatgaactcaaaggcaaggttgatttgaccgtcgccctgatccacgaaggtgttccagcccgccagtccagtatgggaggcacagatgtgcgtcgcgcgttggataaagatattcagacggcaagtcaggtgaaagggctggatattttgatcaccggacatgcacatgtgggtacgccggaaccgattaaagtcggcaatacgctcatcctctccactgacagcggcgggattgatgtgggcaaactggttctcgactacaaagagaagccgcataattttacggtgaaaaacttcgagcttaaaaccatttacgctgacgagtggaagcccgatccgcaaacgaaacaggtgatcgacggctggaataaaaagcttgatgaagtggtgcaacaaacggtggcgcaatcgccggttgaattaaaacgtgcctatggtgaatcggcttccctcgggaacctggcggctgacgctttactggcagcagcgggtaaaaatacccaactggcgttaacaaactctggtggtatccgcaatgagatccccgcaggggcgatcacgatgggcggcgtcatcagtaccttcccgttccccaacgaactggtgacgatggaactcacgggtaaacaattacgcagtctgatggaacacggcgcaagtttaagcaatggcgttttacaggtatcgaaaggcctggaaatgaagtacgacagcagcaagccggttggtcagcgggtaatcacactgactctgaatggcaaacccattgaagatgcgacggtttatcacattgctactcagagtttccttgctgatggtggagatggttttaccgcctttaccgaagggaaagcgcgtaacacaacgggcggttattacgtttatcacgcggtggttgattacttcaaagcgggcaacaccattacggatgaacagctcaacggtatgcgcgtgaaggatatcaaataaaagtgcgcactgaattgactcaactgtttgttacccgttgattgcgcagatcctgtattcggcctacgcgagggcgcaggccgaatcagatgccttaacatcaccatccggtggcaggacgttgtttttcgaattagcccaggtgtcgctgtgttgtcagaatatgagtcaaaacgtgcgaggtggattgcgctatagagaaatcttttatcgcctctaattaagatgagtttttttcatcttccctgatttttcctcaccatcattggttatttttcggttgacgcccttcggcttttccttcatctttacatctggacgtctaaacggatagatgtgcacaacacaacatataacgacaagcgattgatgaggtaaggtatgagcttttttcacgccagccagcgggatgccctgaatcagagtctggcagaagtccaggggcagattaacgtttcgttcgaatttttcccgccgcgtaccagtgaaatggagcagaccctgtggaactccatcgatcgccttagcagcctgaaaccgaagtttgtatcggtgacctatggcgcaaactccggcgagcgcgaccgtacgcacagcattattaaaggcattaaagatcgcaccggcctggaagcggcaccgcatcttacctgcattgatgcgacgcctgccgagctgcggatcattgcacgcgactactggaataacggtattcgccatatcgtggcgctgcgtggcgacctgccgccgggaagtggtaagccagaaatgtatgcttctgacctggtgacactgttaaaagaagtggcagatttcgatatctccgtggcggcgtatccggaagtacatccagaagcgaaaagtgcccaggccgatttactcaacctgagacgaaaagtggatgccggagccaaccgcgccattactcagttcttcttcgatgtcgaaagctacctgcgttttcgcgatcgctgcgtctcggcaggcattgatgtggaaatcattccgggaattttgccggtttcgaactttaaacaggcgaagaaatttgccgacatgaccaacgtgcgtattccggcgtggatggcacaaatgttcgacggcctggatgacgatgctgaaacccgcaagctggtgggcgcgaatattgccatggatatggtgaagattttaagccgtgaaggagtgaaagatttccacttctatacgcttaaccgcgctgaaatgagttacgcgatttgccatacactgggagttcgacctggtttataaatagtgtgccttttgtgaaaatcacacagtgttcacaaattttaaacagagcacaaaatgctgcctcgaaatgagggcgggaaaataaggttatcagccttgttttcgccttcattacttgaagggtaccaggctaaaaccttttcttataaagcatttatcctaaatcggacataatcaaaaagtcttaattacgatcaatttgatctacatctctttaaccaacaatatgtaagatctcaactatcgcatccgtggattaattcaattataacttctctctaacgctgtgtatcgtaacggtaacactgtagaggggagcacattgatgagcacgtcagacgatatccataacacgacagccaccggcaaatgcccgttccatcagggcggtcacgaccagagcgcaggtgggggcacaaccacgcgcgactggtggccaaatcaactccgtgttgacctgttaaaccaacattctaatcgttctaacccgctgggtgaggactttgactaccgcaaagaattcagcaaattagattactacggcctgaaaaaagatctgaaagccctgctgacagaatctcaaccgtggtggccagccgactggggcagctacgccggtctgtttattcgtatggcctggcacggcgcgggtacttaccgttcaatcgacggtcgcggcggcgcgggtcgtggtcagcaacgttttgcaccgctgaactcctggccggataacgtaagcctcgataaagcgcgtcgcctgttgtggccaatcaaacagaaatatggtcagaaaatctcctgggccgacctgtttatcctcgcgggtaacgtggcgctggaaaactccggcttccgtaccttcggttttggtgccggtcgtgaagacgtctgggaaccggatctggatgttaactggggtgatgaaaaagcctggctgactcaccgtcatccggaagcgctggcgaaagcaccgctgggtgcaaccgagatgggcctgatttacgttaacccggaaggcccggatcacagcggcgaaccactttcggcagcagcagctatccgcgcgaccttcggcaacatgggcatgaatgacgaagaaaccgtggcgctgattgcgggtggtcatacgctgggtaaaacccacggtgccggtccgacatcaaacgtaggtcctgatccagaagcagcaccgattgaagaacaaggtttaggctgggcgagcacttacggcagcggcgttggcgcagatgccattacctctggtctggaagtggtctggacccagacgccgacccagtggagcaactatttcttcgagaacttgttcaagtatgagtgggtacagacccgcagcccggctggcgcaatccagtttgaagcggtagacgcaccggaaattatcccggatccgtttgatccgtcgaagaaacgtaaaccgacgatgctggtgaccgacctgacgctgcgttttgatcctgagttcgagaagatctctcgtcgtttcctcaacgatccgcaggcgttcaacgaagcctttgctcgtgcctggttcaaactgacgcacagggatatggggccgaaatctcgttacatcgggccggaagtaccgaaagaagatctgatctggcaagatccgctgccgcagccgatctacaacccgaccgagcaggacattatcgatctgaaattcgcgattgcggattctggtctgtctgttagtgagctggtatcggtggcctgggcgtctgcttctaccttccgtggtggcgacaaacgtggtggtgccaacggtgcgcgtctggcattaatgccgcagcgtgactgggatgttaatgccgcagccgttcgtgctctgccagttctggagaaaattcagaaagagtctggtaaagcctcgctggcagatatcatcgtgctggcaggtgtggttggcgttgagaaagccgcaagcgccgcaggtttgagcattcatgtaccgtttgcgccgggccgcgttgatgcgcgtcaggatcagactgacattgaaatgtttgagctgctggagccaattgctgacggtttccgtaactaccgcgctcgtctggacgtttccaccaccgagtcactgttgattgataaagcacagcaactgacgctgaccgcgccggaaatgactgcgctggtgggcgggatgcgcgtactgggtgccaacttcgatggcagcaaaaacggcgtcttcactgaccgcgttggcgtattgagcaatgacttcttcgtgaacttgctggatatgcgttacgagtggaaagcgaccgacgaatcgaaagagctgttcgaaggccgtgaccgcgaaactggcgaagtgaaatacacagccagccgtgcggatctggtctttggttctaactctgtcctgcgtgcggtggcggaagtttacgccagcagcgatgcccacgagaagtttgttaaagacttcgtggcagcgtgggtgaaagtgatgaacctcgaccgtttcgacctgctgtaatctgaccttcttcagcgactgcctttcatgcagtcgctgaagtttctttaccggcgtatagtgtccacaggaaaactacacactggatctctcatgtctgccgcaggaaagagcaacccactggcaatcagtggcctggttgtgctcacacttatctggagttatagctggattttcatgaagcaagtcaccagctacatcggtgccttcgacttcaccgccttacgctgcattttcggcgctctcgttttattcatcgttcttttattacgtggtcgcggaatgcgcccgacgccgtttaaatacaccttagccattgccctgttacaaacctgcgggatggttggcctggcacagtgggcgctggtcagcggcggagcggggaaggtggcaatcctgagctataccatgccgttctgggtggtaattttcgccgcattgtttctcggtgaacgcctgcgacgtgggcaatatttcgcgatactgattgccgctttcggcttatttttggtgttgcagccgtggcaactcgatttctcttcgatgaaaagtgccatgctggcaatcctctccggtgtgagttggggggcgagcgcgattgttgctaaacgtctgtatgcccgccatccgcgcgtggatttattgtcgctaacatcctggcagatgctgtatgcggcgctggtgatgagcgtggtcgctttactggtgccgcaacgtgaaattgactggcaacccaccgtgttctgggcgctggcctacagtgcgattctggcgacagcgctggcgtggagcttatggttgtttgtattgaaaaacttgcctgccagtattgccagcttaagcacactggccgttcccgtttgcggcgtactcttttcctggtggctgctcggtgagaatccgggggcagttgaaggtagcggtattgtgctgattgtgctggcactggcgctggtgagccgtaagaaaaaagaagccgtcagtgtaaaaaggatctgaattttttcttcatgtggggagatctcttatttagcaaaataccgatagtgccccaccatccgccagctaaacagtacatcttcttcctgcgcgcctgcgccaatgttatgtatcaccagcggtgtaccgtcgcgggcgaagccatctgacaccaccccaatatgtgccagcccgttatctaatcgccaggagacaatatcgcccgcttgatagtcactggggttcttgctggtggggcgtgttttatcgtggcgggtaaaccaggtttccagattaggcacccgacggtgatcgatgttgctgtccgggcgctttaactgccatttttgcgggtacgcagcaaaattcttcgccatatcttcgtgcaccagtttctgcaaatcgaccttctggctgcgcaatgcacggatcaccacatcggaacatacgccgcgttcttgcgggacatcaccgccaggataggtaagctgcacatacgccggatcgtaaaatagcgtgctgccgatttgctgtctggcgccgtctgcgatggcaagattggtgttagcctggatttgtaccacggttggtggaacggcgggagattttaaggagtaactggtaaataacgtcagaagactgaataacgccagtgaagctttcatctgtttcgtccgtgaaaataagagtcacagattcgaccttccgggctaacgattgttctgtggagaaaatgtccagaagcggataaaaaaacacccgaacaaggtggaagtttcagattactggcacagcgtgccggatgcggcgtgaacgccttatccggcctacaaaagtacgtaaatttactatattgcagagattgcgtaggcctgataagcgtagcgcatcaggcaattttgcgttcaaactcccggacaagccgggagtttggagtaggttattcccactcttgcaggaaacgctgaccatactggtcggctaccagcagtgcggcgtaaacctgatctggcgtcgcgccgccaggcatgttgtggatggtttcaccttctgcacatgccgcttctgccacaattcgcattttcgccgggacatcttctttaatatccagttgagcgagagttattggcaaacctaccgcatggctaagcgcagctacggtttcgatttcctccaccggcgcgttttccagaaccagctgcgtcagcgtaccgaatgccactttttcaccatgataatagtgatgcgcgtccgggatagcggtcaggccgttatgtaccgcgtgtgccgccgccagcccgccgctttcaaaaccaacgccactcaaataggtgttcgcttcaatcacgcgctccagcgccggagtcactacatgctgttcggcggcaagcatcgctttttcgccttcttccagcagggtgttgtagcacagttcagccagtgccagcgctgcctgagtgcacttgccacccgccatggtggtcgcgccgctacgggaacaggcacgcgcttcaaaccaggttgccagcgcatcgccgatacccgccgctaacagacgtgcaggtgcgccagcgacgattttggtgtcgacaatgaccatattcgggttatttggcaacagcagatagcggtcaaactcaccctcatcggtgtagataacagacaatgcgctgcacggtgcgtcggtagaagcgatagtcggtgcgatcgctaccggaacacccatgaaatgtgccagtgctttggcagtatcgagggtttttccgccaccgataccgagaattgcgccacactgcgcagtctccgcgatgccacgcagacggtcgatctcattttgcgaacattcaccgccaaacggcgcaatttctactaccagtccagcatctttaaagcttttctcgacagtggattgagcaaaacctaaaacaaatttgtcacccaccactaaccagcgttccgccagtggcttcaggtactcgcccagacgattaattacatctgcgccctggatgtatttacctggtgattgaataatgcggtccataattactcctttagagatgagtagtgccaaatgcggcattccagtcgtgctcgaacttctctatagctgactctaccgcaggggtgttaagcatttgttgcgctacatctaagggcagtgtgatggattcacatccagccagcaaacaatccagcgcctgacgtggtgttttaaagctggcagccagcaccatgctttctggcgcatgcatttccagtaacgcttgcaactcctgtacagtacgaatgccgtcaccgccctgggcatctacgcggttaacgtatggagcaacgtatttggctccagccagcgccgccagtaatccttgcgcggcgctgtacactgcggttcccagcgtagtaatgccttctttcttcagcattttaattgctgccagaccttcagaggttaccggaattttcaccacaatgcccggaatagcgtcgcgcaggcgtttcgcttctttcaccataccctgcgcgtcgcggctcatggtctgagcaaacagaatgccctcatcaccgatcgctttttgcaggcgcggcagcacttcccagatggactccttgctggcagcgataatgctcgggttagttgtcaccccggcaatcgggaatatgcgtgccagacgttcgacttctgcgacgttagcggtgtccagatacagttccatgatgtttccttttacagttccagttcatgttgcagcaggctggcgatagcgtcggcagaggcggcgttaaccagcgcattacggaattcttcgtgcatgatgcgacgagcgaggcgcgagaaaatgcgcatatgttgatcgcccgcggcgtgtttgttcagggttaacataatgatgaattgcgcttcatcatcgccccagcgcactggcgcttgcagacgcgctacgctgatggtggattgctcaatgtgttccgatttactgtggggaatggcgaaactaaagcccagtccggtagagaaaacggcctcgcgcgcccacaagtcggcttccagtttacgcggatagcggcagcggcccgccagcagcaggttatcggtcatgcctttgagcacttcttctttgctgcgccagtcgctttccagtgtgatgcactcggcggtgaccagcggtgcgtcctgttgggtcatgcggaattgcgccagcaggtgttccacttccagcgaagtacggcaggccattgcctggttgagcaactggcggcactcacggctatcaagttgcgccatccgcgctttcgccgccggaattgatggtgcgctcatgctgagttcatccagccctaaaccgaccagcaacggcagcacggaacctttcgctcccagttcaccgcacagaccaatccatttgccctggcgatgcaccgcctgcacggcgtaatcgagcgcccgcaagaaggccggattcaggctgttgtagtgacgagtcaccttagcgttatcgcgatccactgccagcagatattgcgtcaggtcattactaccaatactaaagaaatcaatctcttcgcagcattgatcgatgatgaacatcaccgacggcacttccagcatgatgccgagctggatcttctcatcaaacggaatgtgttcgttacgcagttgctgtttggcttccgccagtttttctttcacccataagatctcttccattgaggagatcatcgggatcatgattttcaggctgccgtgagcagaggcgcgcaggatcgaccgtagttgtgtggtaaacaacgacgcgtattcttcataaatacgcaccgcgcgataaccgaggaacgggttagcttctgccggaatgttcagataatcaacgggtttatcaccgccaatgtccatagtgcgcacaataatgctgcgtccgttggcagactccagcgcctgacaaaaaatgttgtacagctcgctttcgcccggtgcactggtgcgatccatatagagcatttcagtgcggaacaaaccaacgccttccgcaccattgccgaatgcggcctgcgcttccacggagtgagcgatgttagcggcaatttcaatgcggataccgtcagcggtacgcgcttgttgggtcagccagacacgctgttgctcacgcagagcgtcctgtacgcgggcttcttgctgataataacgggccacggattcccctggctcaaccacaatcgctcctgcgttgccgtcgatataaatcgtttgatgttgccacggagtaagggcatcaatatccacacctaccagcgtcggaatgttgaacgaacgggcaaggatcaccgtatgtgaggtggtgccgccacttttcagtaatagacctttgaggtgatttttatccagttcgaggaactggctgggggtcagttcatcagccatacaaatggcgggctgcgtcagtttgcccggtgccgggaagcgttgctcaccgtagatttgctggagtaactggaagcagacgtcgcgtacgtccagggcacgttcttgcaggtagctgctgctggaacgggcgaactcttcgcaaaagtgattcgcactggcaacaatcgcttcggcgcagcttaatccggcgctgacacctgccagtaaatgttcgcgcagggaagtatcgccagccagggatcggtgcgcttccagaatcgcgctggtagcaccgtcgctatccagcagacgaaactctatgtttttcagtaccagcgtcagaccgttttccagtgcggattgttcggcgtcaacgcctttggctgcgggaagattacccagcgcattgagatctaaagaagagatcggcgtcagaatgccgcctgcgctaccgctgcacacggtgcgagcacggataatttgcggattcagattggtcagtgaaatcggcagtggttccagttcgtcagattttacttccaccagcggtgcgtcgcagtgggggaattcatcgcgcagccactggcttaaacgctggtgcgcttcctgttcgtcggccccggaaatcagtaactggcagttatcgcccaccagcgtatcggtgccaatcagcgcaagggcgcttttggcgttgcccttgcggtcagtgcgcaggttatgccactcaatttgtgatgaaaaagtattacacagcgtttcaacgtggcttgccggacgcgcatgcacgccgttaggtagctcacaaataaattccacaatcagggccattgcctttctcccggtacggttttctgtttacaggataagagcgcacggcaacggcctgccatgtgacaaatctgccaaaagctggacaaatgtaatgtaaccgtcaatttgcgacgcgtctcacaagacgccgttttgcggcgtacttccggattatcgcaagttatgaggcggatcgcatttttgtactgatattacaaaagtccagtaaatggcctttttatccactgtttgctccgcctgcgattgcctattgtttcttccatcaaaaatatggacatgggctttcgcaagcccgggagcagcttatgaatgagttggtgcagatcctgaaaaatacccgtcagcatttaatgacgggcgtttcacacatgattcccttcgtggtatcgggcggtattttgctggcggtttccgtcatgttgtatggcaaaggcgcagtgccggatgccgtagccgatccgaatctgaaaaaactgtttgatatcggcgttgcaggtttgacgctgatggtgcctttcctcgccgcttacatcggttattccattgcagaacgttctgcgctggctccatgcgctatcggtgcctgggttggtaacagctttggcgcgggcttctttggtgcgctgatcgccgggattatcggcggcatcgtggtgcattacctgaagaaaattccggtgcataaagttctgcgctcggtgatgccaatcttcatcattccaatcgtcggcacactgattaccgctggcgtcatgatgtgggggctgggcgagccggtgggggcgttgaccaacagcctgacccagtggcttcaggggatgcagcagggcagcattgttatgctggcggtgatcatgggtctgatgctggcgttcgatatgggcggcccggttaacaaagtggcctatgccttcatgctgatttgcgttgctcagggtgtttataccgtggtggctattgccgctgttgggatttgtgttccaccgctggggatggggctggcgacgctgattggtcgtaaaaatttctccgcagaagagcgcgaaaccggcaaggcggcactggtgatgggctgtgttggcgttactgaaggggcgattcctttcgccgctgccgatccgctgcgtgtcattccttccatcatggtcggttcagtttgtggtgcggtaactgcggcgctggtcggtgcgcagtgctatgcaggctggggtggtctgattgtgctgccggtggttgaaggtaagttgggttacatcgcggcagtggctgtcggggcggttgtgacggcagtctgcgtgaacgtgctgaaaagtctggcgcgtaaaaatgggtcttcaactgaagagaaggaagacgacctggatctggattttgaaattaattaattgaggaacgagccatgacgaaaattatcgcagtaaccgcatgtccttcaggtgttgcccatacttatatggcggcagaggcgctggaaagcgccgcgaaagcgaaaggctgggaagtgaaagtagaaacccaggggtcgattggtctggaaaatgaactgactgcggaagacgtggcaagcgccgatatggtgattttgaccaaagatatcggcatcaaatttgaagagcgttttgctggcaagactatcgtgcgtgtcaacatcagcgacgcggtaaaacgtgctgacgccattatgagcaaaattgaagctcacctggcgcaaaccgcttaagttcttatcccgcccgcaagggcgggttcgctttcccacaggagttcctcatgacgaatcgtatctctcgcctcaaaactgcactgtttgccaatacccgtgaaatctcgctggagcgggcgttgctttataccgccagccatcggcaaaccgaaggggagccggtgataatgcgtcgggcgaaagcaacagcgtatatccttgaacacgttgaaatttcgattcgtgatgaagaactgattgccggtaaccgcaccgtaaaaccacgcgccgggattatgtcgccggaaatggacccttactggctgctgaaagagctggatcaattcccgacgcgtccgcaggaccgctttgctatcagcgaagaagataaacgtatctaccgcgaagagttgttcccgtactgggaaaaacgttcgatgaaagatttcatcaacgggcagatgacggatgaagtaaaagccgcgaccagcacgcagattttcagcatcaaccagacggataaaggccaggggcacattattattgattacccgcgcctgctgaatcacgggctgggggagctggtggcacagatgcagcaacattgtcagcaacagccggagaatcacttttatcaggcagcgctgttactgctggaagcctcgcagaaacatattttgcgttacgccgaactggcggaaacgatggcggcaagctgcactgatggcccgcgtcgcgaagaactgctgaccattgcggagatctcccgccataacgccgaacataagccgcagacgttctggcaggcgtgccagttattctggtacatgaacatcattctgcaatacgaatccaacgccagttcgctatcgttggggcgcttcgaccagtatatgttgccgttctatcaggcatcattaacccagggcgaagatccggcattcctgaaagaactgctcgaatctttatgggtgaaatgcaacgatatcgtgctgttgcgctccaccagtagcgcgcgttatttcgcaggtttccctaccggctataccgcactgctcggcgggttaaccgagaacggacgtagcgcggtgaacgtgctttcgttcctttgccttgacgcttatcaaagcgtgcaattaccgcaaccgaacctcggcgtgcgcactaacgccttgatcgacacgccgttcctgatgaaaaccgcagaaaccattcgcctcggcaccggtattccgcaaatctttaacgatgaagtggtggtgccagcgttcctcaaccgtggcgtttcgctggaagatgcgcgcgactattccgtagtgggctgtgtggaattatctattcccggcagaacctacggcttgcatgacatcgcgatgtttaacctgctgaaagtgatggaaatctgcctgcatgaaaatgaaggcaacgctgcgctgacttatgaaggtttactggaacagatccgcgccaagatcagccactacatcaccctgatggttgagggcagcaatatttgtgatatcggccatcgcgactgggcacctgtaccgctactctcgtcttttatcagcgattgtctggaaaaaggccgcgatattactgacggcggcgcgcgttataacttctccggcgtacaggggatcggtatcgccaacctgagcgattctctccatgcgttgaaagggatgatttttgatcaacagcgtttaagttttgacgaattgctgtcggtattaaaagccaacttcgccacgccagaaggcgaaaaagtccgcgctcgcttaattaaccgcttcgagaaatacggtaacgatatcgacgaggtggataacatcagcgccgaactgttacgccactactgcaaagaagtggaaaaataccagaacccgcgcggcggctacttcacgccaggatcgtataccgtttctgctcacgtcccgttgggatcggtggttggcgcgacgccagacggtcgttttgccggggaacaactggcagacggtggcttgtcacccatgctgggtcaggatgcacaagggccaacggcggtgctgaaatcagtcagtaagctcgataatacgctgctgtctaacggtacgttgctgaacgtgaaattcactccggcgaccctggaaggtgaagcgggattacgcaaactggccgacttcttacgggcgtttacccagcttaagttgcagcatattcagtttaacgtggtgaacgccgacacgttacgggaagcgcaacagcgcccacaagattatgccgggctggtggtgcgcgttgccggatacagcgccttctttgtcgaactgtcgaaggagatccaggatgacatcatccgccggacagcgcatcagctgtaacgttgtggaaacgcgccgcaatgatgtggcgcgcattttcaacattcagcgttattcactgaatgacggcgagggcattcgtacggtggtcttttttaaaggctgtccgcatctttgcccatggtgtgctaatccggagtcgatctccggcaaaatccagacggtgcgcagagaggcgaaatgtctgcactgcgcgaaatgtttgcgtgatgcggatgaatgcccctccggggcatttgaacggattggtcgcgatatcagccttgacgctctggaacgggaagtgatgaaagatgacattttctttcgcacgtccggcggtggcgtcacgctttctggcggcgaagtgttaatgcaggcggagtttgcgacccgttttttacagcgactgcggctatggggtgtgtcatgcgccatcgaaactgccggagacgcgccagccagcaagctgttaccgctggcgaaattgtgcgatgaagtgttgttcgatttaaaaattatggatgcggctcaggcgcgggatgtggtgaagatgaacctgcaacgcgtgctggagaatctgcgtttgctggtgagtgagggtgtcaacgtgatcccgcgtttaccgctgatccctggtttcacgctcagccgggagaatatgcagcaggcgctggacgtgctgatcccgctgaatatcaagcagatccatctgttaccgtttcatcagtacggcgagccgaaataccgcctgctggggaaaacatggtcgatgaaagaggtttctgcgccgtcgtcagccgatgtggcaacgatgcgtgaaatggcagaacgggccggatttcaggttaccgtgggaggttaaaatggcatatctggtggcagtaaccgcctgcgtaagcggtgtggcgcatacttgtatggcggcggaacggctggaaaagttgtgccagttagagaagtggggcgttagcattgaaactcagggcgcgttgggaacggagaatcgtttagcggacgaggatatccgccgggcggatgttgcgctgttaattacggatatcgagcttgccggtgctgagcgatttgaacattgtcgctacgtgcaatgcagcatctacgctttcctgcgtgagccgcagagggtgatgagcgcagtgcgcaaagtgctttctgcgccgcagcaaacccatcttattctggagtagtcggtttttctgtcagttggctgtggtactgccgacgatattccgacggcgagcgttcggtatttttacgaaacagacggcagaagtagttgctgtcgacaaagccgcaggcgtgcgccacttcttttaccttcaggtcatagcctttcaataatgtcttagcgtgctccagtcgcgtgtgattcaggtattcgttaaaaccaatggcccccgttttttgaaacaggtgcgagaggtaatttggcgaaatatagaacgcctgtgcgacagattcgcgggtaagtgcggaggcatagcgttcgtcgatataatcacgaatagcttcgaatagagcctggctgcgtgaggcggtctgtatttggctgccgagcaaatcgcggcagtggctaagcaggctggcgacgataagtctggccgtttgctgctcctgcgactgcatttgcatttcattgagcgtttgtagcagaaaagaaccaatgcgcgggccgcgtcgggcgacgtgttgcttcgccagattttgatattgtttgccatcccattgcacaacgctgaagccgagttgctgtttgccaaacagcacgctaaaggtggtggcgggggcttgccattgtggaaaattccagccaccagcagggacgtacagcacatcgccgggaactaacgctgctccagcgccggtatcaataaactcaccttccagcacaatttccagccgtggaaaatcgacctgatacgcaagatcgggtaccgggccgttgctgctggcaaagtaaatctggcgcagggacagcgggccgttgatcaggcgggagagcagatagctgacgtcgtgatacatgttattcccttaggtatgtagacgggaaaacagtaactggcattatgaaaaaaggccacctgaaaagtgtggcctgatgggagtgagatgtaaacattgcggcagtttcagtcgacttgtattgccggatgcggcgtaaacgccttatccggcctaccgccgcgatctgtaggccggataagacgcgtcaagcgtcgcatccggcaaataacatctggctgataattactgattacccacctgatcgccatacggcagagtgtcgtaatcgatcagtgcgtttttcttatacgggttaccaatccagcgggtagtttctttgaattgcggattcaccactgaacgggttggatcgtaaccgtcgtaagataagcccgccaaatctgaccaggtgtggatcagttccgccaggctgtatttacgatcaacatcctgtgagaaatcacgcggatgagtcgcttgccatttttctgacgtccacagcaggaacggaatggtgtacatatgacgcgtcgggttgtcttcattacgcccctgagttttgtgcggcggcgtgtcgtaaacctcttcaccgtggtcagagaaataaaccaggaaaccgttcggatcggtcgctttaaagtctttaatcaggctggcaaccacgtgatcgttgtacaggttagcattgtcataatcattatatgactccagctcttctgcgtttaatcccggtggaacatgctctgtattaccgtcaaatttgccctgatcttccggataacggtacttgtacttgatatgcgtacccagcagatgaacgatgatcagtttcttcggcgcagggtccttcagcacttcctggaacggcttcagcacgttggtgtcgtattcacgcgcactctgcgtacgttgctggttcatgtagtactgcttgtcggtctggcgcgaaaataccgtcagcatcgtattgcgggcggtcattgtctgctggttggtgatccagaaggttttataacccgcctgtttcatcatgttcatcagcgacggctgcgtcagatacagatccgggttcttttcattggcaaaggtcagcgcctgttgcaggatttcaatggtgtacggacgagacgtaaccacgttattaaacacggtcagattcggatcggttttatgcagcgcatccagctccggcgtggtttcacgcggataaccgtacagactcatgcgtccacgctgggtcgattcgccaattaccagcactaaggtgcgcggttcgttacccgattcatctttgaaattagccagcggcggcaaggcattattttcattcagtagctttgttagcgagtttagttgctgacgatactgataatatccggtcaggaattgccacggtgcggcaggctccatacgcgatgccaggttatccaacgttttctcaaacggcttgttcttgataaacgtattcatggcgatcggatgcagaatcaagccataaagcagggcaaaagagacaacataacgccacggctttggaatatagaccgggcgcaggcgtgtccacagcagaactgccaccgccgtataggccagcgcgataagcacaattttcaggctgaaatactggcttaaatactcgctggcttcgttggtgttggtttcgaacatcacaaacagaacgctctgcgagaactcctgaccgtagatgacgtaatagcacagcgccgccagagaggccgcccatagcaccacgccgatcactgcggcaataattttaatccgcttcggaaagaggaataccgggatcaaccacagcgaactgaataacagcgagtcgcgaatgccgttagtgccactataaccactgatgtaaataatggcctgtagcagagtagagaaaaaccaaaagtagagcagtgcccaacccagggctttccagctaaaaaggggtttagcctggacttctgtggaatgcatagtaagaacctgtcttgaaaaaaatatcgccgaatgtaacgacaattccttaaggatatctgaagggatatccagattttgaataaaatgcagacagaaatatattgaaaacgagggtgttagaacagaagtatttcagaaaaccctcgcgcaaaagcacgagggtttgcaggagaggaagattagccggtattacgcatacctgccgcaatcccggcaatagtgaccattaacgcctgctcgacgcgaggatccggttcctggccttctttttctgcctggcgggagcggtgcagcaactcggcctgcaatacgttcagcgggtcggtgtaaatattccgtagctgaatagactctgcaatccacggcagatcggccatcaggtgagaatcgttggcaatcgccagcaccactttgatgtcttcttcttgcagattgcgtaactctttacctaacggccacagtgctttgtcgaccaggcgttggtcatagtattccgccagccacaggtctgctttggcgaagaccatctccagcatgccgagacgcgtcgagaagaatggccaatcgcggcacatggcttccagctcgctctgtttgccatcttcgaccactttttgcagcgccgtacctgcacccagccaggcggggagcatcaggcggttttgcgtccaggcgaaaatccacggaatagcgcgcagtgactcgacgccgccggttgggcgacgtttcgccggacgtgaacccaacggcagtttacccaattcttgttccggcgtagcggagcggaagtaaggcacaaaatctttgttttcacgtacgtagccgcggtagacatcgcaagagataacagacagttcatccataatacaacgccagctctctttcggctcaggcggtggcagcaggttggcttccagaatcgccccggtgtacagcgacaggctgctgacggtgatttctggcagaccatatttaaagcggatcatctcgccctgttcggtcacgcgcaggccacctttcaggcttcctggcggttgtgacagcagcgccgcatgggcaggtgcgccgccgcgaccaatggaaccgccgcgaccgtggaacaacgtcagctcaatacccgctttttcgcaggttttgattaatgcatcctgtgcctgatattgcgcccaggaagctgccatcacgcccgcatcttttgctgagtcggaatagccaatcatcaccatctgtttgccctgaatcaggccgcgataccagtcgatattcagcagctgggtcatgacatcgttggcgttgttcaggtcatcgagggtttcaaacagcggagcaaccggcatcgcaaacccgatacccgcttctttcagcagcaggtggacagccagcacgtcggacggcgttttcgccatcgagatcacgtaggcggcaatggagccttgcggcgcttcggcaatcacctggcaggtatcgagcacttcgcgcgtttcggcgcttggttgccagttgcgcggtagaagcggacgtttggagttcagttcgcggatcaggaacgcctgtttgtcggcttctgaccagctctcgtagtcgccgataccgaggtagcgggtcagctcgcccagcgcttcggtatggcgggtgctctcctgacggatatcaatacgcaccagcggtacgccgaaacatttcacgcggcgcagggtgtcgagcagatcgccattggcgataatacccatgccacacgcctgaagtgactggtagcaagcgtagagcggttcccacagttcttcgttttgtgtcagcagaccttctggttttggcagttcttcgcctttcaggcgcgcttccagccatgcctgtgtcgccatcaggcgagaacgcaggtttttcatcagatagcgatacggttctgcggcaccctcttcgccaaccagcgccagcagttcaggggtggcttcaaccatcgacagttcagaaaccagaacctgaatatctttcaggaacaaatcggtggctttccagcggctgagtagcaggacgtggcgggtgatatcggcagtgacgttcgggttgccgtcgcggtcaccgcccatccacgaggtaaaacgtaccggagcaaattcgacgggcagtttgtagccgaggttctcttccagttgttcgtttagttcgcgcaggtaattcggtacgccttgccacaggctgttttctactacggcaaagccccatttggcttcatctaccgggcttgggcgcagtttacggatttcatcggtatgccatgactgggcgatcaactggcgcaggcggcgcatcagctggttgtgttcgtagtcggcgatatctttgttatcgagctgttttaagcaggcgttcacttccaccattttgtggatcagtgtacgacgggtaatttcggttgggtgagccgtgaggaccagttccagcgacagcgattccactgcttttttgatggtgtcttcgctcagttccggctggtttttcagtttgcgcagggtgcgggcgatcacttccgggttgctggcagcttcgcctttcggcgaaatgctgtggtattgctcggcggtgttggccaggttcagaaactgactaaacgcacgcgcaacgggcagcagctcgtcgttcgacaaattttgtaaggtggtgagcaactcctggcggttagcatcattgccagcgcgtgaagatttggacaacttacggatagtttctacgcgttcaagaatgtgttctcccaacgcatccttgatggtttctcccagcactttgccgagcatactgacattactacgcaatgcggaatattgttcgttcatattaccccagacaccccatcttatcgtttgatagccctgtatccttcacgtcgcattggcgcgaatatgctcgggctttgcttttcgtcgtcttttataaagccacgtaaaagcggtgacgtcaaatgctgcgaaatcgcttcagcaaacgaataaatagcaggaatttacgccattaaatttacgacgctttaaataagcgtaacttatgggaatgttaaaaaatcgcctcgaataacaccaaaggtgtaggtcggataagatgcgcaagcatcgcatccgacattgtttggcctacgttttaatgccagcaaaaatggtgaatcacctgggtgatcagttcgcgggtgggcttgataaacctcgtctccagatattcatcaggctgatgagcctgattaattgagccaggccccagaaccagcgtcgggcataacgtttgaataaacggcgcttcggtacagtaattcaccacttcggtctttgctccgagcaatttctcaaccacttcaaccagttgatgattcggtgggcattcatagccagggatcggcggatgcagctcgtcgaccgtcagacgacccggccagcgttcgctcactggagccaatgcatcgttgagcaaaccgttaagttcattgagtgtcatgcctggcagcggacgaatatccatatgcaactcacaacaagcgcaaatacggttagatgcatcgccgccgtggatatgcccgaggttgagcgtagggtatggcacggtaaacgcgtcgtagtgataacgttctttcaggttatcgcgcaattgcaaaatatgccctatggcgtcgtgcatcagttcgatagcgttaactccgcgtgctggatcgctggagtggcccgactggccctgaatacggatggcgttagagatatgacctttatgcgcgcgtaccggttgcagcgacgttggctcgccaatgatggcgcaatccgggcgcagggcggtagtttcggcaaaataacgcgctccggccatactggtttcttcatcggcagtcgccagaatgtagagcggttttgcaagcttcgtgacgtcgacatcgcgtagcgcatcaaggataaacgcaaaaaagcctttcatgtcggcggtgcctaagccgtaaagcttgccgtcatgctccgtcaacgtaaatggatcgcgcgtccagcgtccgtcatcaaatggcaccgtatcggtatgccccgccagcaacaaaccgccagccccctgtccgcaactggccagcatattaaatttgttgcgagttcctggcacaggctgtacttccacattgaagcctaaatccttaaaccagtccgccagcagagtgattaaatctgcattgctttgatcgagtgcctcttccgtggcgcttattgaaggtgtggcaatcagagcacggtaaatctcgataaatggcggtaatttgtttttcattgttgacacacctctggtcatgatagtatcaatattcatgcagtatttatgaataaaaatacactaacgttgagcgtaataaaacccaccagccgtaaggtgaatgttttacgtttaacctggcaaccagacataagaaggtgaatagccccgatgttgaatacgctgattgtgggtgccagcggctacgctggcgcagagctagtgacctatgtaaatcgccatccgcatatgaacataaccgctttgactgtttcagcgcaaagcaatgatgcgggaaagttaatctccgatttgcatccgcagctaaaaggcatcgttgatctgccgttgcagccgatgtcggatatcagcgagtttagcccaggggtggacgtggtgtttctcgccaccgcccatgaagtcagccacgatttagcgccgcaatttcttgaagcaggctgtgtggtgttcgacctttccggcgcgtttcgtgttaacgatgtcgccttctatgaaaaatattacggctttacccatcaatacccggaactgctggaacaggcagcctacggtctggcggagtggtgcggtaataaattaaaagaagcgaacttgattgccgtgccaggctgttatccgacggcagcacagctggcgctgaaaccgttgattgatgccgatcttcttgacctcaatcagtggccggtgatcaacgccaccagcggcgtgagcggtgcaggacgtaaggcagcgatttcaaatagtttttgtgaagttagcctgcaaccgtatggcgtctttacccatcgccatcaaccagagatcgccacacacctcggtgctgacgttatcttcaccccgcatctgggcaatttcccgcgcggcattctcgaaaccattacctgccgcctgaaaccgggtgtgagccaggtgcaagtggcgcaagcgttacagcaggcgtatgcccataaaccactggtgcggctgtatgacaaaggcgttccggcgctgaaaaatgtcgttggactgccattctgcgatatcggttttgccgttcagggcgagcatctgattattgtggcgaccgaagacaacttactgaaaggcgcggcggcacaagcggtgcagtgcgccaatattcgtttcggctatgcggaaacgcagtctcttatttaagggtgcaatgatgaatccattaattatcaaactgggtggcgtactgctggatagtgaagaggcgctggaacgtctgtttagcgcactggtgaattatcgcgagtcacatcagcgtccgctggtgattgtgcacggcggcggttgcgtggtggatgagctgatgaaagggctgaatctgccggtgaaaaagaaaaatggcctgcgggtgacgcctgcggatcagatagacattatcaccggagcactggcgggaacggcaaataaaaccctgctggcatgggcgaagaaacatcagattgcggccgtaggtttgtttctcggtgacggcgacagcgtcaaagtgacccagcttgatgaagagttaggccatgttggactggcgcagccaggttcgcctaagcttatcaacagcttgctggagaacggttatctgccggtggtcagctccattggcgtaacaaacgaagggcaactgatgaacgtcaatgccgaccaggcggcgacggcgctggcggcaacgctgggcgcggatctgattttgctctctgacgtcagcggcattctcgacggcaaagggcaacgtattgccgaaatgaccgccgcaaaagcagaacaactgattgagcagggcattattactgacggcatgattgtgaaagtgaacgcggcgctggatgctgcgcgcacgttgggccgtccggtagatatcgcctcctggcgtcatgcggaacagcttccggcactgtttaacggtatgccgatgggtacgcggattttagcttaagttttgttggccggaggcgcagctttccggcattgaatttcaaaataaggaaacagagttatggcactttggggcgggcgttttacccaggcagcagatcaacggttcaaacaattcaacgactcactgcgctttgattaccgtctggcggagcaggatattgttggctctgtggcctggtccaaagccctggtaacggtcggcgtgttaaccgcagaagagcaggcgcaactggaagaggcgctgaatgtgctgctggaagatgttcgcgccaggccacaacaaatccttgaaagcgacgccgaagatatccatagctgggtggaaggcaaactgatcgacaaagtgggtcagttaggcaaaaaactgcataccgggcgtagccgtaatgatcaggtagcaactgacctgaaactgtggtgcaaagataccgttagcgagttgctgacggctaaccggcagttacaatccgctctggtcgagaccgcgcagaacaatcaggacgcggtgatgccgggttacactcacctgcaacgcgcccagccggtgacgttcgctcactggtgcctggcctacgttgagatgctggcgcgtgatgaaagccgtttgcaggacgcgcttaagcgtctggatgtcagcccgctaggttgtggcgcactggcaggaacggcctatgaaatcgaccgtgaacagttagcaggctggctgggctttgcttcggcgacccgtaacagtctcgacagcgtttctgaccgtgaccatgtgttggaactgctttctgctgctgctatcggcatggtgcatctgtcgcgttttgctgaagatctgattttctttaacaccggcgaagcggggtttgtggagctttctgaccgtgtgacttccggttcatcattaatgccgcagaagaaaaacccggatgcgctggagctgattcgcggtaaatgcggtcgggtgcagggggcgttaaccggcatgatgatgacgctgaaaggtttgccgctggcttacaacaaagatatgcaggaagacaaagaaggtctgttcgacgcgctcgatacctggctggactgcctgcatatggcggcgctggtgctggacggcattcaggtgaaacgtccgcgttgccaggaagcggcgcagcagggttacgccaacgctactgaactggcggattatctggtggcgaaaggcgtaccgttccgcgaggcgcaccatattgtgggtgaagctgtggtggaagccattcgtcagggcaaagcgttggaagatctgccgctcagtgagttgcagaaattcagccaggtgattggcgaagatgtctatccgattctgtcgctgcaatcgtgcctcgacaagcgtgcagcaaaaggcggtgtctcaccgcaacaggtggcgcaggcgattgcttttgcgcaggcgcggttggggtaatttgtttatattgctcccctgaaaatggggagcttaccacgcctacaaagtgtgacacttcgtaggcggataaggcgtttacgccgcatcaggcagaaatttgtcagcattctggtgaccttaaatttaacgcccaaccagaaccattatttgtcacattcctttttattcttgcgtcttctttaccttcactctccccataaaaattatattttcaatacatcagccaatacatactttaattaattgaatataattcatttctattgctgtgttcatttttaatgattaatggagtttgttatgtgattatttaacgtattgttttaacgatgatggctaattattcaggtggtttttgagggtgttttttctcctcggtagaaatttttatttttaatgtgatcacggttgaataatcactttttctctcttgtatggtagtaggcgtaaaattaagtttgaagtgtctatttacaatacaggagattgcaataatgaaaattattgctgtggatgtttttgttacttgtcccgggcgtaatttcgttacgcttaaaataaccactgaaagcggactttgtggattaggagatgccacgttaaatggtcgcgaattgtcggtcgcttcttatctgaaagatcatctttgtcctcaattaattggccgcgatgccagccgtatcgaagatatctggcaattcttttataaaggagcttactggcgacgtggtcccgtcacgatgtcggccatttctgccattgatatggcgttgtgggatatcaaagctaaagcggcaaatatgccattgtatcaactgcttggtggcgcttctcgtgaaggcgtgatggtttattgccacaccaccgggcggacgattgatgaagtccttgaagactatgcaaagcaccagcagatgggctttaaggcgattcgtgtgcagtgtggtgtaccgggtatgcaaaccacctatggtctggcgaagggcaaaggactggcgtatgaaccagcaaccaaaggcctgtggccagaagagcagttgtggtcttcagaaaagtatctcgattttacgccgaagttatttgaagcggtgcgtaataagttcggttttaacgaacatctgttgcatgacatgcaccatcgcctgacccccatcgaagcggcgcgctttgggaggagcattgaggattaccgcctgttctggatggaagatccgacgcctgccgagaaccaggaatgttttcgtctgattcgccagcataccgtgacgccgattgcggtcggtgaagtgtttaacagtatctgggactgcaagcagttaatcgaagagcagctgattgactatattcgcacgacgattacccatgcaggcggcattaccgggatgcgacggattgccgattttgcatcgctttatcaggtacgtaccggttcgcatggcccttcagatttatcgcctgtttgccatgcggcggcgctgcattttgacctctgggtgccaaactttggcgttcaggagtacatgggctattccgaacaaatgcttgaagtcttcccgcacagctggcgcttcgatgaaggttatatgcacccaggcgatgaaccggggctgggtatttctttcgatgagaaactggcggcgaaatatccgtatgacccggcgtatctccccgtcgcacgactggaagatggcacattgtggaactggtaatagcggttcgcttaattattttctgaatattcatcaaatcgattaattccgctcaaggagctaaaaatggacgttgatgtgtcaaccagtgttgcgggtaataaaccgcaacggattcgtcgtattcagacagtgaccctggttttattatttatggcggggatcgttaattttctcgaccgttcatcattgagcgtggcaggtgaagcgattcgtggcgagttaggattatcggcgacagagtttggtgttttgctttctgcattttctctgtcttatggtttttcacaacttccttccggtattttgctagaccgctttggcccacgaatagtgttaggcgcaggtttaatattctggtcattaatgcaggcattaacaggaatggttaattcttttagccactttattttaatgcgtatcggtctgggtattggcgaagcgccatttatgcctgcgggagtaaagtcgatcaccgactggtatgcgcaaaaagaacgcggcacggcgctggggatttttaactcatctaccgttatcggtcaggctatcgcgcctcctgctcttgtattgatgcaactggcatggggctggcggacgatgtttgtcatcatcggcgtagcagggattctggttgggatctgttggtacgcgtggtatcgcaaccgggcgcagtttgtcctgaccgaggaagaacggacatatctctccgcgccggttaaaccgcgtccacagttacaatttagcgagtggctggcgctgtttaagcatcggacaacctgggggatgattttaggtttctctggcgtcaattataccggttggctctacatcgcgtggttacccggttatttgcaggccgaacaaggtttcagtctggcgaaaaccggttgggtggcggcaattcctttcctcgcggcggcggtcgggatgtgggttaacggtattgttgtcgatcggctggcgaaaaaaggctatgacctggcgaagacgcgtaaaacggctattgtctgcggtttgatgatgtcggcattaggcacgttgctggtcgtgcaatcttcctcgccagcccaggcggtagcgtttatctcaatggcgctgttctgcgtgcatttcgcgggaacatctgcatgggggctggtgcaggtgatggtgtcagaaacaaaagtggcttccatcgccgggattcaaaactttggcagttttgtttttgcttcctttgctccgatcgtaaccggttgggtcgtggataccacacactcgtttaatctggcgctggttatcgcggcctgtgtgacgttcaccggggcgctgtgttacttctttattgtcaaagatcggattgagtaaccgttactatcaggctctcttgctgtgggcctgtagaataaaaaaaagcggatcctggagatccgcaaaagttcacgttggctttagttattcgagttgagaaactctcgaaacgggcagtgacttcaagggttaaaagaggtgccgctccgtttctgtgagcaattatcagtcagaatgcttgatagggataatcgttcgttgctatgctacctatcgccgcgaactatcgtggcaatggaggatggataatgaatattcgtgatcttgagtacctggtggcattggccgaacaccgccattttcggcgtgcggcagattcctgccacgttagccagccgacgcttagcgggcaaattcgtaagctggaagatgagttgggcgtgatgttgctggagcggaccagccgtaaagtgttgttcacccaggcgggaatgctgctggtggatcaggcgcgtaccgtactgcgtgaggtgaaagtccttaaagagatggcaagccagcagggcgagacgatgtccgggccgctgcatattggtttgattcccacggttggaccgtacctgctaccgcatattatcccgatgctgcaccagacctttccaaagctggaaatgtatctgcatgaagcacagacccaccagttactggcgcaactggacagcggcaaactcgattgcgtgatcctcgcgctggtgaaagagagcgaagcattcattgaagtgccgttgtttgatgagccaatgttgctggctatctatgaagaccacccgtgggcgaaccgcgaatgtgtaccgatggccgatctggcaggggaaaaactgctgatgctggaagatggtcactgtttgcgcgatcaggcaatgggtttctgttttgaagccggggcggatgaagatacacacttccgcgcgaccagcctggaaactctgcgcaacatggtggcggcaggtagcgggatcactttactgcctgcgctggctgtgccgccggaacgcaaacgcgatggggttgtttatctgccgtgcattaagccggaaccacgccgcactattggcctggtttatcgtcctggctcaccgctgcgcagccgctatgagcagctggcagaggccatccgcgcaagaatggatggccatttcgataaagtgttaaaacaggcggtttaagccatttagcgcagctacccgataggcttccgccatcgtcgggtagttaaaggtggtgttgacgaagtactcaatagtgttgccgccacctttctgttccataatcgcctgaccgatatgaataatttcggcagcgcgctcgccaaagcagtgaatacccagaatctcttttgtttcccgatggaacaaaattttcagcgtgcccacgttcatgccgacgatttgtgcacgtgccagatgtttaaactgggcgcggcccacttcatatggcactttcatcgcggtcagctgctgttcggttttgcctacagagctgatttccgggatggtgtaaatgccggtagggatatcttcaatcagatgtgcgttggcttcacctttcaccagcgcctgcgcggcaatgcgcccctggtcataggctgccgacgccaggctcggataaccaatcacgtcgcccaccgcgtaaacgtgcggctgtgcggtctgatacatgctgttgaccttcagctgtccgcgactgtcagtttccagcccaatgttctgtaacgccagcgaatcggtattaccggtgcgaccgttggcatagagcagacagtcagctttcagttttttacccgacttcagatgcatgatcacaccgtcgtcacagccttcgatcttctcgtactcttcgttgtgacgaatcactacgccactgttccagaagtgataggagagagaatctgacatctcttgatcgagaaatgccagcaggcgatcgcgggtgttgatcagatccacttttacatccataccgcggaagatcgacgcatattcacagccgatcactccagcaccgtaaataagtacatggcgcggttcgtggtgcatgctaagaattgagttgctgtcataaatgcgtggatgggtgaaatcaacatctgttggatgatatggacgagagccgcaggcaataacaaatttttcagcagttagtgtttcgacgctgccgtccgggcaatccagcgccaacgtatgctcatcaacaaagcgagcgttcccctgcaatatttcacagtgattacgttcgtaaaatccctgacgcatgcgcgtttgttgattaatcacgttatcggcatggttaaggatatcggcaaaagaagagcggagcagtcgggaatggtcgctgtatagtgggttttgattgaattctataatgcggctgacggcgtgacggagagctttcgacgggatggtgccccagtgggtgcaaccgccgccaacattttgataacgctcgataactgcgacgcgcgcaccttgcttaaccaggcccatcgcagcgccttcgccgccggggccggaacctattactatggcatcgtaatcgtaggaatgtggcatggtagggcttacctgttcttatacataaaagcaacagaatggtaacattttatcgcgggtaagccaattgatccccgtcatttatctggctatatcgtgagcggcctttgctttgtcttcctccttcttattttatttattcactattaatcgctttttcttatggctgatagttttatcttgccgaagcgtgcttttttgttattgtctttatgaaatcttcttataaaacaaatatataaatattttatattgatgagttatttgtatttataccatcaataaaatccgttaattagcctgtttataagtgaataaaggaatagccgatgatcgaacactatattcgtgggtttgaggaagaacttcgcgagatccgccatcagatccacgaaaacccggagctgggattacaagaatttaaaaccagtgctttggttgcggaaaagctgcgccagtggggctatgaggttgagcaagggctggcgacaaccggcgtggtagccacgttaaaagtgggcgacggagagaaaagtattggcctgcgggcggatatggatgcgttgccgatttatgaaaatagtggcaagccctgggccagtaaacatcctggtttaatgcacgcctgcgggcatgacgggcataccaccatactgctgggggctgcgcgttattttgccgaaacccgccgttttaacggcacgttacgccttatcttccagcctgcggaagagatgattaacggcggtgagatcatggttaaagaggggctttttgatcgtttcccctgcgatgtcattttcgggatgcacaacatgccgggtttgccggtcggcaagtttttcttccagcctggggcgctgatggcgtcaatggatcagttccatattacggttcgtggttgtggcggacacggtgcgatcccgcacattgctgcacatatcaccaccgcattacaaagcattgtgtcgcgcaatgtcgatccgctggaagcggcggtaattaccgtcggcagcattgttgcgggtgaggcggctaacgtcattcctgacagtgctgagatgaaaatcagtgtccgctctcttagccgcgatacccgacaacttcttctgacccgtattcctgctcttgcacaagcccaggctgccagctttggcgctacggctgaggttacgcatgttaacggtacaccggtattagtaaatgacgaggagatggcgcgcttcgcctggcaggtggcgtgcaaaacatttggtgaagatcgggctgagtttggcatcaaacccctgatgggcagtgaagatttctctttcatgctggaagcccaacccaaaggcggtttcctgttattcggtaatggcgatgtcggggaaggttcctgcatggtgcataaccccggttacgactttaacgatgcaagcctggtcccggcaagcagctactggggcgcactggttgaagcctggctgcaataaataaaacaacacacaacaacactttttggcaaggaacatggaatgacggcgatcgtaaatgaaaccgtgagtgtgaagaaaaagcccagcggcaggcgggtgatctttgcctcggcgtttggcaatgcgctcgaattttttgattttggcgtttacaacttttttgtggtctatatcagtacgcttttcttcccacccagtgccgatcataacgtcgcgctgttactggcatttgcaacgtttggtgtgagcttttttatgcgtccgctcggtgggattatcgttggtgcctgggccgatcgcttcgggcgtaaaccggcgatggtgttcactattgctctgatgagcctcggtacgctgatgatcggcatcgcaccgacgtatgaaacggcgggctattggggaaccgcaacgctggtgctggcgcgtctaattcagggtgttgcggcaggtggtgaagtcggggcttcaatgtcgctactggtggagtcagctccggcaaatcgtcgcggcttttacagcagttggtcactggcgacccaaggcctggcaacaacttttggcggtgttgtcgctttaggtttaagcgcatggctaccgttcgccacaggttcagaaaccgtaatggcagaatggggctggcgtgtgccgttttttattggcgtgttattagcacctatcggttgctggttgcgtctgagcctggaaaatgacgtacctgagccagtgcgcaataaaaaagctgctaccagcgaaagcgcgttttctctgctcctgcaacataaggcgactatcgttaatggcgttttactcgctattggtagcacggtagcaacctatatttccctcttttattacggcacctgggcggcgaagtatctggcaatgcctcaacactattctcatgcagcgatgttactggcgggggtaattacgtttgtgggcgcgctgttggtggggatgctatgtgattcggttgggcgtaaaaagctgattttaatctcccgtgtgatggtgcttctctgtagctggccgtcattctggctgttggtgaattacccaagccctggcatgttgctgacggtggttttcgtgatggtcagctttaccacgcttggcggtgtgccagtgatgttgttgatctctgaactgttgccgaaacggattcgggcattaggtttcgcgctggtttatagcattggcgtagcaatctttggcggttttgcgcaatatttcgccacgcaatccatcgtgttgctggatagtctgacggctccggcgtggtatctgggtggaggcacgttgctgtcgatgctggcgttgttgtacgtaaaagaaccggccaaagaattgcagtaaatatgttttattgcgttaccgttcattcacaacactggagcaatccagtatgttcattctctggtatagtgccagcagtacttttggcaaggattcagacatcgtgatgggcgtaagagcgcaacaaaaagaaaaaacccgccgttcgctggtggaagccgcatttagccaattaagtgctgaacgcagcttcgccagcctgagtttgcgtgaagtggcacgagaagcaggcattgctcccacctctttttatcggcatttccgcgacgtagacgaactgggtctgaccatggttgatgagagcggtttaatgctacgccaactcatgcgtcaggcgcgtcagcgtatcgccaaaggcgggagtgtgatccgcacctcggtctccacatttatggagttcatcggtaataatcctaacgccttccggttattattgcgggaacgctccggcacctccgctgcgtttcgtgccgccgttgcgcgtgaaattcagcacttcattgcggaacttgcggactatctggaactcgaaaaccatatgccgcgtgcgtttactgaagcgcaagccgaagcaatggtgacgattgtcttcagtgcgggggccgaggcgttggatgtcggcgtcgagcaacgccggcaattagaagagcgactggtactgcagctgcgaatgatttcgaaaggggcttattactggtatcgccgtgaacaagagaaaaccacaattattccgggaaatgtgaaggacgagtaatgaaacaagcaaatcaagatagaggtacgctgctgctagcgttggttgctggcttatcgatcaatggtacttttgcagcgctgtttagctccattgtaccattttctgtattcccgattatttccctggtgttgacagtttactgcctgcatcaacgttatcttaatcgcactatgccggtaggcttgccgggtctggcagctgcttgttttattctcggcgtactgctgtacagcacggtagttcgtgcggaatatccggatatcggctctaacttcttcccggcagtactgtccgtcattatggtgttctggattggcgcgaagatgcgtaaccgtaagcaggaagttgctgagtaatcggtatcatgccggatgcaagcgcatccggcatgggttttacttcgcggtcagtaatacgccgcactccatatggtgcgtgtaggggaactgatcaaatagagccagacgttcgaccttgtgcgtctggcttaatgtttccagattcttgcataacgtttccggattgcaggagatatacagaatacgtggatacgcctgcaccattttctcggtttcactgtccagaccgctgcgcggtgggtcgacaaaaatggtttcgcactgataactctttaagtcgattccttgcaggcggttaaactcgcgcacaccattcatcgcctgagtaaattcttctgccgccatacgaataatttgtacgttatcaatatggttagcggcaatgttgtattgcgcggcggcgactgacggcttggcgatttcggtggctaatacccgatcaaaattgcgtgccagcgctaatgaaaagttaccgttgccgcagtatagctccagtaaatcgccttttgagcctttggttacgtccagcgcccattccagcatctgaatattcatcgccgcgttcggttgggtaaagctgttttctacctgacggtagatcatctctttccctgcgaccggcagacgttcatcgatgtaatcttgatccagctcgattttggttttcgttgcccgaccaatcagatgcacattcagattctgcgctcgcaatgcatcacgcagggcttccgcttcctgacgccactcatcatccagcttcttatggtacagcagggaaaccaccgcctgattactcagcgtggtgaggtaatcaatctggaacaacttgtggcgcagaaagggattattacgcacacccgcaatcatcgccgtcatcaactggttgataagttcactggcggcggggaagctatccacgcggatgcggcttttggtttgttgatcgaaaatgatgtgatacaggtcatcgccatcgtgccagatgcggaactccgcacgcatccggtaatgactgaccggcgagcgaaacacttccggaaccaggttagaaaacggtgccatcatactttgcaaacgtaccactttttcggctaactgcgcttcatactgttctgttggaaggtgttcgggggtcatgatgtatcctgaaaaattaaagtacgcggcgattgtagggattgctcatcagatgtccagatcttgatgaattcctatttgtgagctacgtctggacagtaacttgttacaacctgtagcatccacttgccggtcctgtgagtaaatagggaatccagtgcgaatctggagctgacgcgcagcggtaaggaaaggtgcgatgattgcgttatgcggacactgccatccggtgggaagtcatcatctcttagtatcttagatacccctccaagcccgaagacctgccggccaacgtcgcatctggttctcatcatcgcgtaatattgatgaaacctgcggcatccttcttctattgtggatgctttacaatgattaaaaaagcttcgctgctgacggcgtgttccgtcacggcattttccgcttgggcacaggataccagcccggatactctcgtcgttactgctaaccgttttcaacagcctatcaatactgttctggctccgacggatattgtcacgcgtgaggatatcgaacgctggcaatccagaaccgttctggatgtgatgcgccgcttacctggtgttgatgtcgcacagtatggcggcatgggacagagttcttctctttttatccggggaaccgaatcgaaacacgttctggtgttagttgatggaattccagtagcacgccctggtatatcgaatagctcagacattgaccagatcccagtctcgctggtccagcgtattgaatatattcgtggcccacgctcggctgtttatggctctggtgcaattggtggtgttgtcaacatcatcactatgacgaataaagagcgttcgcaaattaactccagtatcggttcgaaaggctaccaacagtacgatggcacataccgccagcgttttggagatacggtggtgactgctgcaggggcttatcagacgaccaaaggtttcaatgttcagccacactcaagttatagcggagatggcgatcgcgatggttatcgtaacaagctgttctgggggggaattgagcacaaatttaacgatcaatttgatggttacttccgtggctacggttatgccagtaatgccgattacgaccaagggaactggggatatgatggcggcaatgatgagcatcaaaattacacacagtcatgggatactggattgcgttttaattcgggagtctactcttcgcaactggtggtaaattatcagcgcattaaggactacaactacagcagtctgactgggcgttacgcatcaggttatacacttgatgatatggagcaacgttacatccagtggggtaacaatgtcattgttgggcatggtgctatcagcgcaggagcagactggaaacaggaaaaactgatgtcttttggcgctaatggcacggataactacaagcgtaataacactgggctttatctaaccgggcagcagcaaattgataacatcacactagaagcctctggtcgtgaggatcacgatggccagctaggttggcatggcacttggcaaacggcagcagggtggcagtttgttgatggttacaaagtaacgctttcctatggaactggtttccttgctccttcgcttggtcaacaatttggcgcagagcggtttggtattgcttctaaccctaacttgaaaccagaagaatctaagcaatgggaggcaggattagaaggcttgacaggtcctgttgactggcgattgtcgacctatcgctacaaaattcagaacctgatcgactacaacaacaatacctattttaacgttaaatccgcgaccattaagggcctggaatggacgggtaatttcacaactggtcctatcgatcatcgtttaacgttgcagtatgtagacccccgtgatgatgaaactgatcaacaactctatcgccgtgcaaaacagcaggtaaaatatgagttgagcggtgaggtttacgagttggggtgggatgtcacgtatcagtacattggtgaacgatacgattacgactatgacagtacccgtaaggtgaaaatggggggactgagcgtgtgggatatcggactttcatatccggtcacctctcacctgacagttcgtggtaaaatagccaacctgttcgacaaagattacgagacagtctatggctaccaaactgcaggacgggaatataccttgtctggcagctacaccttctgaaccacgtcccaccgtgctggtgtttgactccggcgtcggtgggttgtcggtctatgacgagatccggcatctcttgccggatctccattacatttatgctttcgataacgtcgctttcccgtatggcgaaaaaagcgaagtgtttattgttgagcgagtggtggaaattgtcaccgcagtgcaagaacgttatccccttgcgctggctgtggtcgcttgcaacaccgccagtaccgtttcacttcctgcattacgcgaaaagttcgacttcccggttgttggtgtcgtgccggcgattaaacctgctgcacgtctgacggcaaatggcattgtcggattactggcaacccgcggaactgttaaacgttcttatactcatgagctgatcgcgcgtttcgctaatgaatgccagatagaaatgctgggctcggcagagatggttgagttggctgaagcgaagctgcatggcgaagatgtttctctggatgcgctaaaacgtatcttacgcccgtggttaagaatgaaagagccgccagatacagttgtattgggttgcacccatttccctctactacaagaagaactattacaagtgctgccagagggaacccggctggtggattctggcgcagcgattgctcgccgaacggcctggttgttagagcatgaagccccggatgcaaaatctgccgatgcgaatattgcattttgtatggcaatgacgccagaagctgaacaattattgcccgttttacagcgttacggcttcgaaacgctcgaaaaactggcagttttagattgatttggttgaatgttgcgcggtcagaaaattattttaaatttcctcttgtcaggccggaataactccctataatgcgccaccactgacacggaacaacggcaaacacgccgccgggtcagcggggttctcctgagaacttcggcagagaaagcaaaataaatgcttgactctgtagcgggaaagcgtaatatacgccacctcgcgacagtgagctgaaagccgcgtcgcaactgctctttaacaatttatcagacaatctgtgtgggcactcgaagatacggattcttgacgtcgcaagacgaaaaatgaataccaagtctcaggagtgaacacgtaattcattacgaagtttaattctttgagcatcaaacttttaaattgaagagtttgatcatggctcagattgaacgctggcggcaggcctaacacatgcaagtcgaacggtaacagaaagcagcttgctgctttgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaacctttgggagggcgcttaccactttgtgattcatgactggggtgaagtcgtaacaaggtaaccgtaggggaacctgcggttggatcacctccttaccttaaagaagcgtactttgaagtgctcacacagattgtctgatagaaagtgaaaagcaaggcgtcttgcgaagcagactgatacgtccccttcgtctagaggcccaggacaccgccctttcacggcggtaacaggggttcgaatcccctaggggacgccacttgctggtttgtgagtgaaagtcacctgccttaatatctcaaaactcatcttcgggtgatgtttgagatatttgctctttaaaaatctggatcaagctgaaaattgaaacactgaacaacgagagttgttcgtgagtctctcaaattttcgcaacacgatgatgaatcgcaagaaacatcttcgggttgtgaggttaagcgactaagcgtacacggtggatgccctggcagtcagaggcgatgaaggacgtgctaatctgcgataagcgtcggtgaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgcgcgatacagggtgacagccccgtacacaaaaatgcacatactgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcctcttaatggggtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacactatgtgttgttgggtaggggagcgttctgtaagcctgtgaaggtggcctgtgagggttgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaaccaaggctgaggcgtgatgacgaggcactacggtgctgaagcgacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagcggcaacgcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttggcccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagacttagagtctcctgaaggaacgttgaagacgacgacgttgataggccgggtgtgtaagcgcagcgatgcgttgagctaaccggtactaatgaaccgtgaggcttaaccttacaacgccgaagatgttttggcggatgagagaaagattttcagcctgatacagattaaatcagaacgcagaagcggtctgataaacagaatttgcctggcggccttagcgcggtggtcccacctgaccccatgccgaactcagaagtgaaacgccgtagcgccgatggtagtgtggggtctccccatgcgagagtagggaactgccaggcatcaaattaagcgaagagcccagtcggaagactgggcctttttgcgtttctataaactcttcctgtcatcatatctacaagccatccccccacagatacggtaaactagcctcgtttttgcatcaggaaagcagctatgaaccactccttaaaaccctggaacacatttggcattgatcataatgctcagcacattgtatgtgccgaagacgaacaacaattactcaatgcctggcagcatgcaaccgcagaaggacaacccgttcttattctgggtgaaggaagtaatgtactttttctggaggactatcgcggcacggtgatcatcaaccggatcaaaggtatcgaaattcatgatgaacctgatgcgtggtatttacatgtaggagccggagaaaactggcatcgcctggtaaaatacactttgcaggaaggtatgcctggtctggaaaatctggcattaattcctggttgtgtcggctcatcacctatccagaatattggtgcttatggcgtagaattacagcgagtttgcgcttatgttgattgtgttgaactggcgacaggcaagcaagtacgcttaactgccaaagagtgccgttttggctatcgcgacagtatttttaaacatgaataccaggatcgcttcgccattgtagccgtaggtctgcgtctgccaaaagagtggcaacctgtactaacgtatggtgacttaactcgtctggatcctacaacagtaacgccacagcaagtatttgatgcggtgtgtcatatgcgcaccaccaaactccctgatccaaaagtgaacggtaatgcgggtagtttcttcaaaaatcctgttgtttctgccgaaactgctaacgcgttgttggcgcaatttccaacagccccacattacccccaggtggatggttcagtaaaactggccgcgggttggctgattgatcagtgccagcttaaagggacgcaaattggtggggctgcggtacaccgtcaacaggcgctggttctcataaatgagcacgatgcaaaaagcgaagatgttgtacagctggcgcatcatgtaagacaaaaagtgggtgaaaaatttaatgtctggcttgagcctgaagtccgctttattggtgcatcaggtgaagtgagcgcagtggagacaatttcatgaaggataacaccgtgccactgaaattgatcgccctgttagcgaacggtgaatttcactctggcgagcagttgggtgaaacgctgggaatgagccgggcggctattaataaacacattcagacactgcgtgactggggcgttgatgtatttactgttccgggtaaaggatacagcttgcccgagccaatccagttacttaatgccgaaaagatattgagtcagctggatgacggcagtgtagccgtgctgccagttattgactccacgaatcagtatctcctggaccgcatcggagagcttaaatctggcgatgcctgtgttgcagaataccagcatgctggccgtggtcgtcgtggtcggaaatggttttcgccttttggcgcgaacttatatttgtcgatgttctggcgtctggaacagggcccggcggcggcgattggtttaagtctggttatcggtatcgtgatggcggaagtattacgcaagctgggtgcagataaagttcgtgttaaatggcctaatgacctctatctgcaggatcgtaagctggcaggcattcttgtggagctgactggcaaaaccggcgatgcggcgcaaatagtcattggtgcagggatcaacatggcaatgcgtcgtgttgaagagagtgtcgttaatcaagggtggatcacgctgcaggaagccgggatcaatctcgatcgtaatactcttgcggccatgctgatacgtgaattacgcgcggcgctggaactcttcgagcaagaaggattgacaccttatctttcgcgctgggaaaagttggataattttattaatcgcccagtgaaacttatcattggtgataaagaaatatttggcatttcacgcggaatagacaaacagggtgctttattacttgagcaggatggaataataaaaccctggatgggcggtgaaatatccctgcgtagtgcagaaaaataagaaaggggagcattagctcccctgaaaattatttgcgtagtctgacctcttctactgcatgattagcacttttcgtcaggatcaaactggcacgctcgcgagtaggtagaatattttgctttaagttcagccagttgatctctttccacaatgtcatggcagtcttaatagcttcttctttagttaatttcgcgtagttatgaaaataggaatccgggtctgtaaaagccccttcgcggaatttcagaaaacggttgatataccacgtctgaagtaagtcttccggtgcatcaacatatatcgaaaaatcgacaaaatcagaaacaaatacatgatgtggatcgtgtggataatccatcccgctctgtaagacatttaacccttcaagaattaaaatatcaggctgaacaacagttttatctccatccgggatcacatcataaataagatgcgagtaaacaggggctgtaacgtttggcacgccggatttgagatcggaaacaaacttcaccaggcgatgcatatcatacgattccgggaagcctttcttcttcatcagaccacgttctttcagaacctgattagggtgaaggaagccatctgtagtgatcagttcaacacgacgatgttccggccaacggcttaatagcgcctgcaatacacgggcggttgtacttttccccaccgcgacactaccagcaatactgataatgtaaggaatgcgttgcccgttggtaccaagaaactgttccagaactgcctgacggcgcagattcgagcttatatagaagttcagcaaacgtgacagaggtaaatagatctcggcaacttcttctaacgagagatcttcattaatacctttgagacgggcgatctcatcttccgataacgtcatcggtacggaatcacgcagagctgcccactggttgcggtcaaactgtaggtaaggcgtcattaacgtttgctcttttatactcataagcatgtttctggcggtcatagctctatcggcaaagcgatatttgccatggcgcgtcacagttctgttgaatgggttaatgggcaggagggtaacaccagatggggaggaataataagaaaaaatctctcccaggaagctatcgttgaaaagcaatgtgacagatattccatctgataaaaagaattatggtttagcaggagcacattgttgagcacaatgatgttgaaaaagtgtgctaatctgccctccgttcggctgtttcttcatcgtgtcgcgtaaaatgtgaccaataaaacaaattatgcaattttttagttgcatgaactcgcatgtctccatagaatgcgcgctacttgatgccgacttagctcagtaggtagagcaactgacttgtaatcagtaggtcaccagttcgattccggtagtcggcaccatcaagtccggtggggttcccgagcggccaaagggagcagactgtaaatctgccgtcacagacttcgaaggttcgaatccttcccccaccaccaatttcggccacgcgatggcgtagcccgagacgataagttcgcttaccggctcgaataaagagagcttctctcgatattcagtgcagaatgaaaatcaggtagccgagttccaggatgcgggcatcgtataatggctattacctcagccttccaagctgatgatgcgggttcgattcccgctgcccgctccaagatgtgctgatatagctcagttggtagagcgcacccttggtaagggtgaggtcggcagttcgaatctgcctatcagcaccacttcttttctcctccctgttttttccttctgtttattgcattcaacaagtcgggcatgttgcctggttgatgtggtgatatcaccgatttatccgtgtcttagagggacaatcgatgtctaaagaaaagtttgaacgtacaaaaccgcacgttaacgtcggtactatcggccacgttgaccatggtaaaacaacgctgaccgctgcaatcactaccgtactggctaaaacctacggcggtgctgctcgcgcattcgaccagatcgataacgcgccggaagaaaaagctcgtggtatcaccatcaacacttctcacgttgaatacgacaccccgacccgtcactacgcgcacgtagactgcccggggcacgccgactatgttaaaaacatgatcaccggtgctgctcagatggacggcgcgatcctggtagttgctgcgactgacggcccgatgccgcagactcgtgagcacatcctgctggggcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcctacattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggtcgtcatactccgttcttcaaaggctaccgtccgcagttctacttccgtactactgacgtgactggtaccatcgaactgccggaaggtgtagagatggtaatgccgggcgacaacatcaaaatggttgttaccctgatccacccgatcgcgatggacgacggtctgcgtttcgcaatccgtgaaggcggccgtaccgttggcgcgggcgttgtagcaaaagttctgagctaattgccgataacatttgacgcaatgcgcactaaaagggcatcatttgatgccctttttgcacgctttcgtaccagaacctggctcatcagtgattttctttgtcataatcattgctgagacaggctctgttgagggcgtataatccgaaaagctaatacgcgtttcgatttggtttgcctcgcgatcgcggggtgaaaatgtttgtagaatacttctgacaggttggtttatgagtgcgaataccgaagctcaaggaagcgggcgcggcctggaagcgatgaagtgggtcgttgtggtggcattgctcctggtagcgattgtcggcaactacctttatcgcgacattatgctgccgctgcgtgcgctggccgtagtaattctgattgctgcagcgggtggtgtcgcgctgttaacgacaaaaggtaaagcaaccgttgcttttgcccgtgaagcgcgtaccgaagtccgtaaggtcatttggccgactcgccaggaaacattgcacaccacgctgattgtggctgcggttaccgcagtaatgtcactgatcctgtggggactggatggtattctggttcgcctggtatcctttatcactggcctgaggttctgagatgtctgaagctcctaaaaagcgctggtacgtcgttcaggcgttttccggttttgaaggccgcgtagcaacgtcgctgcgtgagcatatcaaattacacaacatggaagagttgtttggtgaagtcatggtaccaaccgaagaagtggttgaaatccgtggcggtcagcgtcgcaaaagcgaacgtaaattcttccctggctacgtcctcgttcagatggtgatgaacgacgcgagctggcacctggtgcgcagcgtaccgcgtgtgatgggcttcatcggcggtacttccgatcgtcctgcgccaatcagcgataaagaagtcgatgcgattatgaaccgcctgcagcaggttggtgataagccgcgtccgaaaacgttgtttgaaccgggtgaaatggtccgtgttaatgatggtccgttcgctgacttcaacggcgttgttgaagaagttgattacgagaaatctcgtctgaaagtgtctgtttctatcttcggtcgtgcgacccctgtagagctggacttcagccaggttgaaaaagcttaacccagcgatcaaaaaagcggcgatttaatcgttgcacaaggcgcgagattggaatacaatttcgcgccttttgtttttatgggccttgcccgtaaaacgattttttatatcacggggagcctctcagaggcgttattacccaacttgaggaatttataatggctaagaaagtacaagcctatgtcaagctgcaggttgcagctggtatggctaacccgagtccgccagtaggtccggctctgggtcagcagggcgtaaacatcatggaattctgcaaagcgttcaacgcaaaaactgattccatcgaaaaaggtctgccgattccggtagtaatcactgtttacgctgaccgttctttcactttcgttaccaagactccgccggcagcagttctgctgaaaaaagcggctggtatcaagtctggttccggtaagccgaacaaagacaaagtgggtaaaatttcccgcgctcagctgcaggaaatcgcgcagaccaaagctgccgacatgactggtgccgacattgaagcgatgactcgctccatcgaaggtactgcacgttccatgggcctggtagtggaggactaagaaatggctaaactgaccaagcgcatgcgtgttatccgcgagaaagttgatgcaaccaaacagtacgacatcaacgaagctatcgctctgctgaaagaactggcgactgctaaattcgtagaaagcgtggacgtagctgttaacctcggcatcgacgctcgtaaatctgaccagaacgtacgtggtgcaactgtactgccgcacggtactggccgttccgttcgcgtagccgtatttacccagggtgcaaacgctgaagctgctaaagctgcaggtgctgaactggtaggtatggaagatctggctgaccagatcaagaaaggcgaaatgaactttgacgttgttattgcttctccggatgcaatgcgcgttgttggccagctgggccaggttctgggtccgcgcggcctgatgccaaacccgaaagtgggtactgtaacgccgaacgttgctgaagcggttaaaaacgctaaagctggccaggttcgttaccgtaacgacaaaaacggcatcatccacaccaccatcggtaaagtggactttgacgctgacaaactgaaagaaaacctggaagctctgctggttgcgctgaaaaaagcaaaaccgactcaggcgaaaggcgtgtacatcaagaaagttagcatctctaccaccatgggtgcaggtgttgcagttgaccaggctggcctgagcgcttctgtaaactaatgcctttacgtgggcggtgattttgtctacaatcttacccccacgtatgctaacgaaagttagcagctaaaaagatttgttcgttggagcctggcctatccaggcctccgtcgaagaccgcaggagtttcgcaagaaacttaatcccctgcgtagacggtgacagaacgctaagattattcttttatattctggcttgtttctgctcaccgtaattaagacgctctctccgtttggaggagtgaagtgagttccagagattttctctggcaaacatccaggagcaaagctaatggctttaaatcttcaagacaaacaagcgattgttgctgaagtcagcgaagtagccaaaggcgcgctgtctgcagtagttgcggattcccgtggcgtaactgtagataaaatgactgaactgcgtaaagcaggtcgcgaagctggcgtatacatgcgtgttgttcgtaacaccctgctgcgccgtgctgttgaaggtactccgttcgagtgcctgaaagacgcgtttgttggtccgaccctgattgcatactctatggaacacccgggcgctgctgctcgtctgttcaaagagttcgcgaaagcgaatgcaaaatttgaggtcaaagccgctgcctttgaaggtgagctgatcccggcgtctcagatcgaccgcctggcaactctgccgacctacgaagaagcaattgcacgcctgatggcaaccatgaaagaagcttcggctggcaaactggttcgtactctggctgctgtacgcgatgcgaaagaagctgcttaatcgcagttatctttttaacgcattcgcttacgtataaacttattctgatattcaggaacaatttaaatgtctatcactaaagatcaaatcattgaagcagttgcagctatgtctgtaatggacgttgtagaactgatctctgcaatggaagaaaaattcggtgtttccgctgctgctgctgtagctgtagctgctggcccggttgaaactgctgaagaaaaaactgaattcgacgtaattctgaaagctgctggcgctaacaaagttgctgttatcaaagcagtacgtggcgcaactggcctgggtctgaaagaagctaaagacctggttgaatctgcaccggctgctctgaaagaaggcgtgagcaaagacgacgcagaagcactgaaaaaagctctggaagaagctggcgctgaagttgaagttaaataagccaacccttccggttgcagcctgagaaatcaggctgatggctggtgactttttagtcaccagcctttttgcgctgtaaggcgccagtagcgtttcacactgtttgactactgctgtgcctttcaatgcttgtttctatcgacgacttaatatactgcgacaggacgcccgttctgtgtaaatcgcaatgaaatggtttaagcgtgatagcaacaggcattgcggaaagtgttccattttccggtcaacaaaatagtgttgcacaaactgtccgctcaatggacagatgggtcgacttgtcagcgagctgaggaaccctatggtttactcctataccgagaaaaaacgtattcgtaaggattttggtaaacgtccacaagttctggatgtaccttatctcctttctatccagcttgactcgtttcagaaatttatcgagcaagatcctgaagggcagtatggtctggaagctgctttccgttccgtattcccgattcagagctacagcggtaattccgagctgcaatacgtcagctaccgccttggcgaaccggtgtttgacgtccaggaatgtcaaatccgtggcgtgacctattccgcaccgctgcgcgttaaactgcgtctggtgatctatgagcgcgaagcgccggaaggcaccgtaaaagacattaaagaacaagaagtctacatgggcgaaattccgctcatgacggacaacggtacctttgttatcaacggtactgagcgtgttatcgtttcccagctgcaccgtagtccgggggtcttttttgactccgacaaaggtaaaacccactcttcgggtaaggtgctgtataacgcgcgcatcatcccttaccgtggttcctggctggacttcgaattcgatccgaaggacaacctgttcgtacgtatcgaccgtcgccgtaaactacctgcgacaatcattctgcgtgccctgaactacaccacagagcagatcctcgacctgttctttgaaaaagttatctttgaaatccgtgataacaagttgcagatggaactggtgccggaacgcctgcgtggtgaaaccgcatcttttgacatcgaagctaacggtaaagtgtacgtagaaaaaggccgccgcattactgcgcgccatattcgccagctggaaaaagacgacgtcaagctgatcgaagtttcggttgagtacatcgcaggtaaagtggttgctaaagactacattgatgagtctaccggcgagctgatctgcgcagcgaacatggagctgagcctggatctgctggctaagctgagccagtctggtcataagcgtatcgaaacgctgttcaccaacgatctggatcacggcccatatatctctgaaaccttacgtgtcgacccaactaacgaccgtctgagcgcactggtagaaatctaccgtatgatgcgccctggcgagccgccgactcgtgaagctgctgaaagcctgttcgagaacctgttcttctccgaagaccgctatgacttgtctgcggttggtcgtatgaagttcaaccgttctctgctgcgcgaagaaatcgaaggttccggtatcctgagcaaagacgacatcattgatgttatgaaaaagctcatcgatatccgtaacggtaaaggcgaagtcgatgatatcgaccacctcggcaaccgtcgtatccgttctgttggcgaaatggcggaaaaccagttccgcgttggcctggtacgtgtagagcgtgcggtgaaagagcgtctgtctctgggcgatctggataccctgatgcctcaggatatgatcaacgccaagccgatttccgcagcagtgaaagagttcttcggttccagccagctgtctcagtttatggaccagaacaacccgctgtctgagattacgcacaaacgtcgtatctcggcactcggcccaggcggtctgacccgtgaacgtgcaggcttcgaagttcgagacgtacacccgactcactacggtcgcgtatgtccaatcgaaacccctgaaggtccgaacatcggtctgatcaactccctgtccgtgtacgcacagactaacgaatacggcttccttgagactccgtatcgtaaagtgaccgacggtgttgtaactgacgaaattcactatctgtctgctatcgaagaaggcaactacgttatcgcccaggcgaactccaacctggatgaagaaggccacttcgtagaagacctggtaacttgccgtagcaaaggcgaatccagcttgttcagccgcgaccaggttgactacatggacgtatccacccagcaggtggtatccgtcggtgcgtccctgatcccgttcctggaacacgatgacgccaaccgtgcattgatgggtgcgaacatgcaacgtcaggccgttccgactctgcgtgctgataagccgctggttggtacgggtatggaacgtgctgttgccgttgactccggtgtaactgcggttgctaaacgtggtggtgtcgttcagtacgtggatgcttcccgtatcgttatcaaagttaacgaagacgagatgtatccgggtgaagcaggtatcgacatctacaacctgaccaagtacacccgttctaaccagaacacctgtatcaaccagatgccgtgtgtgtctctgggtgaaccggtagaacgcggcgacgtgctggcagacggtccgtccaccgatctcggtgaactggcgcttggtcagaacatgcgcgtagcgttcatgccgtggaatggttacaacttcgaagactccatcctcgtatccgagcgtgttgttcaggaagaccgtttcaccaccatccatattcaggaactggcgtgtgtgtcccgtgataccaagctggggccggaagagatcaccgctgacatcccgaacgtgggtgaagctgctctctccaaactggatgaatccggtatcgtttacattggtgcggaagtgaccggtggcgacattctggttggtaaggtaacgccgaaaggtgaaactcagctgaccccagaagaaaaactgctgcgtgcgatcttcggtgagaaagcgtctgacgttaaagactcttctctgcgcgtaccaaacggtgtatccggtacggttatcgatgttcaggtctttactcgcgatggcgtagaaaaagacaaacgtgcgctggaaatcgaagaaatgcagctcaaacaggcgaagaaagacctgtctgaagaactgcagatcctcgaagcaggtctgttcagccgtatccgtgctgtgctggtagccggtggcgttgaagctgagaaactcgacaaactgccgcgcgatcgctggctggagctgggcctgaccgacgaagagaaacaaaatcagctggaacagctggctgagcagtatgacgaactgaaacacgagttcgagaagaaactcgaagcgaaacgccgcaaaatcacccagggcgacgatctggcaccgggcgtgctgaagattgttaaggtatatctggcggttaaacgccgtatccagcctggtgacaagatggcaggccgtcatggtaacaagggtgtaatttctaagatcaacccgatcgaagatatgccttacgatgaaaacggtactccggtagacatcgtactgaacccgctgggcgtaccgtctcgtatgaacattggtcagatcctcgaaacccacctaggtatggctgcgaaaggtatcggcgacaagatcaacgccatgctgaaacagcagcaagaagtcgcgaaactgcgcgaattcatccagcgtgcgtacgatctgggcgctgatgttcgtcagaaagttgacctgagtaccttcagcgatgaagaagttatgcgtctggctgaaaacctgcgcaaaggtatgccaatcgcaacgccggtcttcgacggtgcgaaagaagcagaaattaaagagctgctgaaacttggcgacctgccgacttctggtcagatccgcctgtacgacggtcgcactggtgaacagttcgagcgtccggtaaccgttggttacatgtacatgctgaaactgaaccacctggtcgacgacaagatgcacgcgcgttccaccggttcttacagcctggttactcagcagccgctgggtggtaaggcacagttcggtggtcagcgtttcggggagatggaagtgtgggcgctggaagcatatggcgcagcatacaccctgcaggaaatgctcaccgttaagtctgatgacgtgaacggtcgtactaagatgtataaaaacatcgtggacggcaaccatcagatggagccgggcatgccagaatccttcaacgtattgttgaaagagattcgttcgctgggtatcaacatcgaactggaagacgagtaattctcgctcaaacaggtcactgctgtcggggtaaaacccggcagcggattgtgctaactccgacgggagcaaatccgtgaaagatttattaaagtttctgaaagcgcagactaaaaccgaagagtttgatgcgatcaaaattgctctggcttcgccagacatgatccgttcatggtctttcggtgaagttaaaaagccggaaaccatcaactaccgtacgttcaaaccagaacgtgacggccttttctgcgcccgtatctttgggccggtaaaagattacgagtgcctgtgcggtaagtacaagcgcctgaaacaccgtggcgtcatctgtgagaagtgcggcgttgaagtgacccagactaaagtacgccgtgagcgtatgggccacatcgaactggcttccccgactgcgcacatctggttcctgaaatcgctgccgtcccgtatcggcctgctgctcgatatgccgctgcgcgatatcgaacgcgtactgtacttcgaatcctatgtggttatcgaaggcggtatgaccaacctggaacgtcagcagatcctgactgaagagcagtatctggacgcgctggaagagttcggtgacgaattcgacgcgaagatgggggcggaagcaatccaggccctgctgaagagcatggatctggagcaagagtgcgaacagctgcgtgaagagctgaatgaaaccaactccgaaaccaagcgtaaaaagctgaccaagcgtatcaaactgctggaagcgttcgttcagtctggtaacaaaccagagtggatgatcctgaccgttctgccggtactgccgccagatctgcgtccgctggttccgctggatggtggtcgtttcgcgacttctgacctgaacgatctgtatcgtcgcgtcattaaccgtaacaaccgtctgaaacgactactggacctggctgcgccggatatcatcgtacgtaacgaaaaacgtatgctgcaggaagcggtagacgccctgctggataacggtcgtcgcggtcgtgcaatcaccggttctaacaagcgtcctctgaaatctttggccgacatgatcaaaggtaaacagggtcgtttccgtcagaacctgctcggtaagcgcgttgactactccggtcgttctgtaatcaccgtaggtccatacctgcgtctgcatcagtgcggtctgccgaagaaaatggcgctggagctgttcaaaccgttcatctacggcaagctggaactgcgtggtcttgctaccaccatcaaagctgcgaagaaaatggttgagcgcgaagaagctgtcgtttgggatatcctggacgaagtgatccgcgaacacccggtactgctgaaccgtgcaccgactctgcaccgtctgggtatccaggcatttgaaccggtactgatcgaaggtaaagctatccagctgcacccgctggtttgtgcggcatataacgccgacttcgatggtgaccagatggctgttcacgtaccgctgacgctggaagcccagctcgaagcgcgtgcgctgatgatgtctaccaacaacatcctgtccccggcgaacggcgaaccaatcatcgttccgtctcaggacgttgtactgggtctgtactacatgacccgcgactgtgttaacgccaaaggcgaaggcatggtgctgactggcccgaaagaagcagaacgtctgtatcgctctggtctggcttctctgcatgcgcgcgttaaagtgcgtatcaccgagtatgaaaaagatgctaacggtgaattagtggcgaaaaccagcctgaaagacacgactgttggccgtgccattctgtggatgattgtaccgaaaggtctgccttacaccatcgtcaaccaggcgctgggtaaaaaagcaatctccaaaatgctgaacacctgctaccgcattctcggtctgaaaccgactgttatttttgcggaccagatcatgtataccggctttgcatatgcagcgcgttctggtgcatctgttggtatcgatgacatggtcatcccggagaagaaacacgaaatcatctccgaggcagaagcagaagttgctgaaattcaggagcagttccagtctggtctggtaactgcgggcgaacgctacaacaaagttatcgatatctgggctgcggcgaacgatcgtgtatccaaagcgatgatggataacctgcaaactgaaaccgttattaaccgtgacggtcaggaagagaagcaggtttccttcaacagcatctacatgatggccgactccggtgcgcgtggttctgcggcacagattcgtcagcttgctggtatgcgtggtctgatggcgaagccggatggctccatcatcgaaacgccaatcaccgcgaacttccgtgaaggtctgaacgtactccagtacttcatctccacccacggtgctcgtaaaggtctggcggataccgcactgaaaactgcgaactccggttacctgactcgtcgtctggttgacgtggcgcaggacctggtggttaccgaagacgattgtggtactcatgaaggtatcatgatgactccggttatcgaaggtggtgacgttaaagagccgctgcgcgatcgcgtattgggtcgtgtaactgctgaagacgttctgaagccgggtactgctgatatcctcgttccgcgcaacacgctgctgcacgaacagtggtgtgacctgctggaagagaactctgtcgacgcggttaaagtacgttctgttgtatcttgtgacaccgactttggtgtatgtgcgcactgctacggtcgtgacctggcgcgtggccacatcattaacaaaggtgaagcaatcggtgttatcgcggcacagtccatcggtgaaccgggtacacagctgaccatgcgtacgttccacatcggtggtgcggcatctcgtgcggctgctgaatccagcatccaggtgaaaaacaaaggtagcatcaagctcagcaacgtgaagtcggttgtgaactccagcggtaaactggttatcacttcccgtaacaccgaactgaaactgatcgacgaattcggtcgtaccaaagaaagctacaaagtaccttacggtgcggtactggcgaaaggcgatggcgaacaggttgctggcggcgaaaccgttgcaaactgggacccgcacaccatgccggttatcaccgaagtaagcggttttgtacgctttactgacatgatcgacggccagaccattactcgtcagaccgacgaattgacaggtctgtcttcgctggtggttctggattccgcagaacgtaccgcaggtggtaaagatctgcgtccggcactgaaaatcgttgatgctcagggtaacgacgttctgatcccgggtaccgatatgcctgcgcagtacttcctgccgggtaaagcgattgttcagctggaagatggcgtacagatcagctctggtgacaccctggcgcgtattccgcaggaatccggcggtaccaaggacatcaccggtggtctgccgcgcgttgcggacctgttcgaagcacgtcgtccgaaagagccggcaatcctggctgaaatcagcggtatcgtttccttcggtaaagaaaccaaaggtaaacgtcgtctggttatcaccccggtagacggtagcgatccgtacgaagagatgattccgaaatggcgtcagctcaacgtgttcgaaggtgaacgtgtagaacgtggtgacgtaatttccgacggtccggaagcgccgcacgacattctgcgtctgcgtggtgttcatgctgtgactcgttacatcgttaacgaagtacaggacgtataccgtctgcagggcgttaagattaacgataaacacatcgaagttatcgttcgtcagatgctgcgtaaagctaccatcgttaacgcgggcagctccgacttcctggaaggtgaacaggttgaatactctcgcgtcaagatcgcaaaccgcgaactggaagcgaacggcaaagtgggtgcaacttactcccgcgatctgctgggtatcaccaaagcgtctctggcaaccgagtccttcatctccgcggcatcgttccaggagaccactcgcgtgctgaccgaagcagccgttgcgggcaaacgcgacgaactgcgcggcctgaaagagaacgttatcgtgggtcgtctgatcccggcaggtaccggttacgcgtaccaccaggatcgtatgcgtcgccgtgctgcgggtgaagctccggctgcaccgcaggtgactgcagaagacgcatctgccagcctggcagaactgctgaacgcaggtctgggtggttctgataacgagtaatcgttaatccgcaaataacgtaaaaacccgcttcggcgggtttttttatgggtgttattcagagggcaaagtcttcacggaaaatattaagaaaggcagggcgaaacgaggaagaagcttttcgccctggacaacattcctgctgacggcactaccataaaaaaacacaacgctttcaacaaccttgcgtttttcatcttccgtagcggctcggaataaatttacgttcttacatactgtctcatgccctttgcgatgggcgtcccagatagctgtcccagtctttccataccggctgcaaaccctgagcggttaacgcggcagcaaccgcttccggtctgcgatcgtcgtgcggtgagaactgttccagctcggggtggttgtcggcatagccacctggctgcgttttcgaaaaagcgctgacgttattaattgccagcggaatcacgcgatcgcgaaaccacggtgattcccgcgtggagagtgacagttcaatctccggtgcaagcagccggaaagcgcagatggcttgcactaactggcgttcatccataatcgacgcaggctcaatgccgccagtacatggacgcaggcgtgggaaggagacagagtagcggctttgccagtaatgctgttgcagccatagcaaatgttcgacaaccatatagcagtcaactcgccagctgtcggaaaggccgattagcgcgccgaggcctatcttatcaatccccgcacgccctagccgatccggcgtttccagccgccagaagaagtcctgttttttacctttcagatgatgatgggcataagtcgcctcatgatatgtctcctgataaaccattactccatcgaggccaagctgttttaactcggcatattccgcctccgccagcggttgcacttccatctgtagtgaagagaactgttcacgcagggcagggagatgacgacgaaagtaatccatccccactttcgcctgatgttcaccagtgactaatagcagatgttcaaagcccatctcccgtatagcggcgctttctctggcaatatccgcttcatccagcgttttgcgcttgatgcggttgctcatagaaaatccgcaataagtacagtcgttagcgcaaagattggaaagataaagcgggacgtagaagctgacgacgttgccaaatcgctgacgagtcagacgttgcgctcgctgggccagtggttccagatagccactggcggcgggtgatagcaatgccatcatgtcgtcgcgggtgagttgcgaggcatttagcgcccgctctacgtcagcagccgttttgccgttgatacgcaggtggatgtcatcccagtccagttgtcgccagcgatcgctaaaggttttcatgccgatgcctccagaaatccagtcagcgggctggtggcatgagcaaaatgactgcggctgcccggtccggactgacgtgccagcaggcctgcttctaccgccagacgaaatgccttcgccatgttgacgggatcgtccgcgacggcaatcgccgtattcactaacaccgcgtcggcccccatttccagcgcctgcgcggcatggctgggaacgccgatgccagcatcgacaaccaccggaacggtggcctgctggataataatctccagcatggcgcgggtttccagtccctgattcgagccaatcggcgcgccgagcggcatcaccgctgcacagccgacttcttccagacgtttacacaataccggatcggccccgcagtaaggcagcacgataaatccctgttgtaccagcgtttcggcggctttcagggtttcgatgggatcgggcaacagccagcgggcgtcagggtgaatctccaattttagccagtttgtgcctaacgcttcacgtgccagatgggcggcgaaaatggcttcttccgcggttttcgccccggaagtattcggcagcagggtcacacccgccgcgataagcggttcgaggatagcgtcgttgtgctggcgcaagtcgacacgtttcatcgccagcgtcaccagttggctgccgcaagcgcggatcgcctccaccatcagttgtgaagaggcgaattttccggtgccagtaaacagatgtgaagcaaacgttttgtccgcaatatgtaacatctcaaccccctgcaataacctgaaaaagcaggatctggtcgccatcctgcacgatatgttgcgcccattgttcccgcgggacgatttgctgattaatcgccagtgccgcacctgcttgttgttgatcgagttgcttcagcagttcgtgaacagttagtccggcgacacactgcatcggttgatcgttaaacaggatctgcattgcatcctccacataccgggcaaccgttggcgcggcgcaacgtcaggctgcgccactggctcgatttaccgtcgaacagtcggagttctcccgcaggcgtctctataccgcttaataacttaatggcttccagggcctgcaaagtgcccataaccccgaccaccgggccaaccacgcccgccgtgcggcagttgcgttctggctcctggttatctggccacaggcagcggtaacacccctgctcccagggcggcgtcagtaccatcaactgaccgccaaattcgaccgcgctggcggtgataagcggcgtgttgagtgccacgcaggtggcattaatctcctggcgagtcgccatattgtcagtacagtcgagcaccacatcggcttgtgcaaccgcatcttttaacgtctcacccgttaatcgttgttgtaatgccatcagttgaatgtcgggattcaactgtgtcagtcgctgttggctgacctgtgatttcgggcgatcgatatcttcagtggtaaagaggatttgtcgttgcagattgcttaaatgcacatcgtcgtcatctgccagtaccagcgtcccgacgccagcccccgccaggtatagcgcagcaggtgtacccagcccgccaagaccaataatcagcacctggctgtcgagcagtttttgctgcccgtccagagcgatatcgtcgagcaggatttggcggctataacgcataaagtcacggtcattcatcgccaactcctgcaatttccagcagctgtgccgttgccaaacgccagtctgcggcttgagtaatggcgctgacgacggcgatactgccgacacccgttgctatcaccgcaggcgcgcgcgccagactgataccgccaatcgccacggtgggataatccgccaggcgctcaacatgccgtgccagctgttccagtccctgcggtgcagaaggcatctgtttggtttgtgtcggaaacacatgtcccagcgcgatataagaaggacgttccgccagcgcgacgtcgatctccatatcgtcatgggtcgaaacgcccagccgcaggcctgccgcgcggatggcgctgagatcggtggcttgcaaatcttcctgccccagatggacgccatacgcctgatgcttaatcgccagccgccagtaatcgttgataaacaatcgcgcgttatagcggcggcccagcgcaattgccgccaccacatcggcttctacctcttcatcgcgccgatctttgatgcgtagctggagagtacgtacgcctgcatccaacagacgttcgatccactgtacgctgtcaaccaccgggtacagtcctaaacgaaagggtacaggaggaaactcaggctgatacatcacgcttcctccttacgcaggtagatttctccgcctctggcgcggaagttctccgacatatccgccattcccacttcaatggtttgcgcggcggcgtaatcacgcacttcctggctgattttcatcgagcagaatttcggtccacacatggagcaaaaatgggcgactttaccggactcttgcgacagggtttcatcgtgataagcgcgggcagtaaacgggtcgagggccagattaaactggtcttcccagcgaaattcgaagcgggctttcgacatggcgttatcgcgaatttgcgcgcccggatgccctttcgccaggtcggcggcgtgagcggcaatcttataggtgataagcccctgtttaacatcttctttatttggcaggcccagatgctctttcggcgttacgtagcagagcattgcacaaccaaaccagccaatcatcgccgcgccaatccctgacgtgaagtggtcatagcccggcgcgatatcggtagttagcggccccagagtgtaaaacggcgcttcgtggcagtgctctaactcctcggtcatattgcggcgaatcatctgcatcggcacgtggcctgggccttcaatcatcacctgtacgtcatattcccaggcgattttagtcagttcacccagcgtatgcagctcggcaaactgtgcttcatcgttggcgtcctgaatagaaccggggcgcaggccgtcgcccagcgatagcgaaacgtcataagcagcacagatttcacaaatttcgcggaagtgttgatagaggaaattttcctgatgatgggagaggcaccatttcgccataatcgaaccgccgcgagagacgataccggtcaggcgtttcgcggtcatcggcacgtagcgcagcagcacccccgcatggatcgtgaagtaatccacaccttgctcggcttgttccagcagggtgtcgcggaagacttcccaggtaagatcttcagcgatcccgttcaccttctccagtgcctggtagatcggcactgtaccgatcggcaccgggctgttacgcaaaatccactcgcgggtttcgtgaatatagcgaccagtggaaagatccatcacggtatccgctccccagcgtgtggaccataccagtttttccacttcttcttcgatggaagaagtgaccgctgagttgccgatattggcgttaacttttaccaggaagttacggccaataatcatcggctccgattccggatgattaatgttggccgggataatcgcacgtccggcagcaacttcatcacggacaaattccgcagtgatattttccggcagacgtgcgccaaagctcattcccggatgctggtggcgtaaaacttcgctacgtatgcgctcgcgacccatattctcgcgaatggcgatgaattccatttctggcgtgatgatacccttgcgggcgtagtgcagttgtgtgacgcggtggcctgctttggcgcgttttggggttaatacgccgctaaaacgcagctcgtcgaggccatcatctgccagccgcgcttttgtgtaatcggaactgcgcacggtaagttcttcggtatcgccgcgcgcatcgatccacggctggcgtagttttgccagcccttgctgcacgttaatggcaatctgcggatcgccatacgggccggaggtgtcgtagaccggaatcgcttcgttttcttcgtactgcggctgttctttgctgccgccaattagcgtcgggctaagctgaatctcacgcatcggcacgcgtacgccggggtgtgtgccagtgatgtaaatgcgttttgagttgggaaaggcggagccttccagggtgtcgataaaatgttgggcctgggcgcgttgttcgcggcgggtcagttttgttgcagacatagctcgttccaaaaagttaaggacgtggcttgtcagacgacggatgaagcaagagacgatcgccgcaaaggcgatgcgatagcagattaactcttgttcccttcgcaggtattagcctgatcaggttccgcggatcccgaataaacggtctcagccagttaaggcactccgacaagaaattagccccacaaacggggcgttgaatgtaaattacgcgttaacagcgcagaactcaagcaggatatttgacgcgggcggcgtcaagcaccagtagaatcagcttatcttccagcacaaagcgcgcttccagtgcctcgccgatgtcagataaaacctgttgaaactcaaggtaattatcatgatcgatggcggtttccagactggaatcgtagtcatccataatctgttgagtattggcttcgagttgtggccaaatcttcgcggcgcgtgcgagttgcccattgccttccagcttatgaagaatgcgctcataaatactgaaatgtccggcagacaagtaatcgaccaggctctgacaaaaatcatcaagggctttttcgtttagcctcatgtacgattctttgccaggcttaatgccaaccagattgtagtaagccacgagcagatgcttacgtacatgtagccagcgatcaaccagtttgttacttcctctgacgcgctccgtcaggttatcgagctggttaagcatgattgactccgcaagtttgtattcaaaaactgctctgtgagaaatgtaaaaaccatgttaaacatgccagtgatgcaaaggtagtgcaagagctatggatcgtataattgaaaaattagatcacggctggtgggtcgtcagccatgaacaaaaattatggttgccgaagggagaattgccatatggcgaagcggcaaatttcgatcttgtgggtcagcgcgcactacaaatcggcgaatggcagggggaacctgtttggttagtacaactgcagcggcgtcacgatatggggtcggtacgtcaggtcattgatctcgatgttgggctgtttcaactggccggacgtggcgtgcaactggcggagttttaccgatcgcataaatactgtggttactgcgggcatgaaatgtatccaagcaaaaccgaatgggcgatgctgtgcagccattgccgtgagcgttactacccgcaaatcgccccctgcattattgttgccatccgtcgcgatgattcgatcctcctcgcccagcatacccgccatcgtaacggtgtccatacagtacttgccggattcgtcgaagtgggtgaaaccctcgagcaggcagtcgcgcgggaagtgatggaagagagcggaattaaagttaaaaacttgcgttacgtgacctcccaaccgtggccgtttcctcagtcgttaatgaccgcgtttatggcggaatatgacagcggcgagatcgtgatcgacccgaaagaattgcttgaggcgaactggtatcgctatgacgatttgccgttactcccgccgcccggcaccgtagcgcgccgtctgatagaagatacagtggcgatgtgtcgggcagagtatgagtgatgatacactgaccgcctgacgcactaaggaacagccaaaatgaccgaacttaaaaacgatcgttatctgcgggcgctgctgcgccagcccgttgatgtcactccagtatggatgatgcgccaggcgggtcgctatctaccggaatataaagccacgcgcgcccaggcgggcgattttatgtcgctgtgcaaaaatgccgagctggcgtgcgaagtgactttgcaaccgctgcgtcgctatccgctggatgcggcgatcctcttttccgatatcctcaccgtgccggacgcgatgggtttagggctctattttgaagccggagaaggtccgcgttttacctcgccagtcacctgcaaagccgatgtcgataaactgccaattccggacccggaagatgagctgggttacgtgatgaacgcggtgcgtaccattcgtcgcgaactgaaaggcgaagtgccgctgattggtttttccggcagcccgtggacgctggcgacctacatggtggaaggcggcagcagcaaagcgttcaccgtgatcaaaaaaatgatgtatgccgatccacaggcgctgcacgcgctactcgataaactggcgaaaagcgtcactttgtatctgaatgcgcagattaaagccggtgctcaggcagtcatgattttcgacacctggggcggcgtgcttaccgggcgcgattatcaacagttctcgctctattacatgcataaaattgttaatggtttactgcgtgaaaacgacggtcgccgcgtaccagtcacgctgtttactaaaggcggtggacagtggctggaagcgatggcagaaaccggttgcgatgcgctgggcctcgactggacaacggacatcgccgatgcgcgccgtcgcgtgggcaataaagtcgcgctgcagggtaatatggacccgtcgatgctgtacgcgccgcctgcccgcattgaagaagaagtggcgtctatacttgccggtttcggtcacggcgaaggccatgtctttaaccttggtcacggcattcatcaggatgtgccgccagaacatgcaggcgtgtttgtggaggcagtgcatcgcttgtctgaacagtatcaccgctaaggagcgattatggatctcgcgtcattacgcgctcaacaaattgaactggcttcttctgtgatccgcgaggatcgactcgataaagatccgccggatctgatcgccggagccgatgtcggatttgagcagggcggagaagtgacgcgagcggcgatggtgctgctgaaatacccctcgcttgagctggtggagtataaagtggcccgcatcgccaccaccatgccttacattccaggttttctctcgttccgcgaatatcctgcgctgctggcagcgtgggagatgctgtcgcaaaagccggatttagtgtttgtcgatggtcatgggatctcgcatcctcgccgtcttggcgtagccagccattttggcttattggtggatgtgccgaccattggcgtagcgaaaaaacggctctgcggtaaattcgaaccgctctccagcgaaccgggcgcgctggccccgctgatggataaaggcgagcagctggcctgggtctggcgcagcaaagcgcgctgtaacccgttgtttatcgctaccggccatcgggtcagcgtggacagcgcgctggcgtgggtacaacgctgcatgaaaggctatcgtctgccggagccaacgcgctgggcggacgcggtggcctcggaacgtccggcgttcgtgcgctatacagcaaatcagccctaattcaggtaaactgcggataatttccgtatttgagaactcaacatgttacaaaacccaattcatctgcgtctggagcgcctggaaagctggcagcatgtcacttttatggcctgcttatgcgaacgcatgtaccccaattacgccgtattctgtcagcaaaccggcttcggcgatgggcagatttaccgccgcattctcgatctcatttgggaaacgctgaccgtcaaagacgcaaaagtaaatttcgacagccaactggagaaatttgaagaagcgattccttcagccgacgatttcgatctgtacggcgtttatccggcaatcgatgcttgcgtggcgttaagtgaactggtccattcgcgtttaagtggcgaaacgctcgaacacgcggtggaagtgagtaagacttccatcacgaccgtggcgatgctggaaatgactcaggctggtcgcgaaatgagcgatgaagagctcaaagaaaacccagctgtagagcaagaatgggacattcagtgggaaatattccgacttttagctgagtgcgaagaacgcgatatcgagctgataaaaggccttagggcagacctgcgtgaggcgggtgagagcaatattggtataatttttcagcaataagaccagaaaacgtgatttaacgcctgatttgtcgtacctggagtcttccctttcgccccccgtctggtctacatttggggggcgaaaaaaagtggctatcggtgcgtgtatgcaggagagtgctattctggcatttccgtcgcactcgatgcttagcaagcgataaacacattgtaaggataacttatgaacaagactcaactgattgatgtaattgcagagaaagcagaactgtccaaaacccaggctaaagctgctctggagtccactctggctgcaattactgagtctctgaaagaaggcgatgctgtacaactggttggtttcggtaccttcaaagtgaaccaccgcgctgagcgtactggccgcaacccgcagaccggtaaagaaatcaaaattgccgcagctaacgtaccggcatttgtttctggcaaggcactgaaagacgcagttaagtaagattgcgtggcagtgaacagttttaacgaaggggtggtttcaccccttttgtctttctggcgtcgatcattgatgctggcaggcgctctgtttctcactgcctgtagtcacaactcttcacttcctccctttaccgccagtggatttgctgaagaccagggcgcggtacgcatctggcgaaaagacagcggcgataatgtgcatctgcttgccgtgtttagcccgtggcgcagtggcgataccacgacgcgagagtatcgctggcagggcgataaccttacgctcatcaatatcaatgtttacagcaaaccgccggtgaacattcgcgcgcgttttgacgatcgcggcgatctgagctttatgcaacgtgaatccgatggggaaaagcagcagctttctaacgaccaaatcgatttataccgttatcgtgctgatcagatccgccagattagcgatgccttacgtcaggggagagtcgtgctgcgccaggggcgctggcatgcgatggaacagaccgtgaccacctgcgaagggcaaaccattaaacctgatttagattcgcaggcgatagcgcatatcgagcgccgccagagccgctcttctgttgatgtcagcgtggcatggctggaagcgcccgaaggttcgcaattactgttggtggcaaactctgatttctgtcgctggcaacccaacgagaaaacgttctgatttaccagtggcccatacccatatgaccgccaccaccgcagtcgccgtaacccattccggtaccgcgcggaatacccgcttcagccatcgcaatatctcgtttcacccgtaactcatctaacgactgacgcaaattctccatctctttggcgaccgcgttaattttgctgctatccggtgggttcgcggctaacagggcattgtattcataacgctttgtcaccagttgctgttgcagtgcgctgctttgagcgtaaaagtcattatggattttctgccacgctgtctgttgttcgctggtcaaaggcgcggcattttgctgccacataccatgtccgccgtgagcaaatgcagatgtcgatcccatcgccattgctgaaagcgccatcattaccagggcaattttcgtgttccgtttcatggttaatcctccagtggttgtcttacttcgggtattgcatcttccgtgccaacggcgaaacgctgatatgacgggtaatctggcatgataaacgagtaaaaatgactcgcctgctgcgggtagcgagtcatttttactcattgaaacttaagcctttgtgttacagctcagggtaagcgctgataaaagatggcatgatttctgctgtcagaaagggatggacaggcaaagaagaagatgcgttttatgcaacgttctaaagactccttagctaaatggttaagcgcgatcctccccgtggtcattgttgggctggtggggctgtttgcggtgacagtgattcgcgattatgggcgcgagactgccgccgccagacaaacgctgctggaaaaaggcagtgtacttattcgtgctcttgaatccggctcgcgcgtcggcatggggatgcgcatgcatcatgcgcagcagcaggccttacttgaagaaatggccgggcagcctggagtacgttggtttgcggtcacggatgaacaaggaacaatcgtgatgcatagcaactccggcatggtgggaaaacagctttattccccgcaggaaatgcagcagttacatccgggaaatgaagaagcgtggcggcggatcgatagcgcagacggcgagcctgttctggaaatttatcgccagtttcaaccgatgtttgctactggaatgcaccggatgcgccatatgcagcagtatgccgcgacaccacaagcaatttttatcgctttcgacgccagtaacattgtgagtgccgaagatcgtgagcagagaaacaccctgattatcctcttcgccctggcgacggtcttgctggcaagcgtgttgtcattcttctggtatcgccgatatctgcgctcgcggcagctattgcaggatgaaatgaagcgcaaagagaagctggtggcactggggcatctggcggcaggcgttgcccacgaaatccgtaacccactttcctcgattaaagggctggcgaaatactttgccgaacgcgcgtcagcagggggagaagcgcatcaattggcgcaggtgatggcgaaagaagccgaccgtttaaaccgcgtggtaagcgagctgctggaactggttaagccaacgcatctggctttgcaggcggtggagctcaacacgctgattagccactcattacagctggtaagccaggatgcaaacagccgggagatccagttacgctttaccgccaacgacacattaccggaaattcaggccgatccggacaggctgactcaggtcctgttgaatctctatctcaacgctattcaggcgattggtcagcatggcgtgattagcgtgacggccagcgaaagcggcgcgggcgtgaaaatcagcgttaccgacagcggtaagggaattgcggcggatcagcttgaagccatcttcactccgtacttcaccaccaaagccgaaggcaccggactggggctggcggttgtgcataatattgttgaacaacacggtggtacaattcaggtcgcaagccaggagggaaaaggcgcaacgttcaccctttggcttccggtcaatattacgcgtaaggacccacaaggatgacgcacgataatatcgatattctggtggtggatgatgacattagccactgcactattttgcaggctttgctgcgcggctggggctataacgtcgcgctggcgaacagcgggcgacaggcgctggagcaggtgcgggaacaggtttttgatcttgtgctttgcgatgtacgaatggcagagatggatggtatcgccacgctaaaagagatcaaaacattaaaccccgcgattccggtgctgattatgaccgcgtactccagcgtcgagacggcggtagaggcgttgaaaaccggggcgctggattatctcatcaagccgctggatttcgataacctgcaggcgacgctggaaaaggcgctcgcgcatacacacagtgttgacgctgaaacgcctgcggtgtctgccagccagttcggtatggtcggtaaaagcccggcgatgcaacacctgctcagtgaaatcgccctcgtcgcgccatcggaagccacggtgctgatccacggcgattccggcaccggtaaagagctggtcgccagggcgattcacgccagtagcgcacgtagcgaaaaaccgctggtaacgctcaactgcgcggcgctcaacgaatccttgctggagtctgaattgttcggtcacgaaaaacgggcgtttaccggggccgacaaacgccgggaagggcgctttgttgaggcggacggcggcacgctgtttctcgatgaaattggcgatatctcgccgatgatgcaggttcgtctgctgcgtgcgattcaggagcgcgaagttcagcgtgtcggcagcaaccagaccatctcggttgatgtccggctgattgcggcgactcatcgcgatcttgccgcagaggtgaatgccgggcgttttcgccaggatctctactatcgcctgaacgtggtggcgattgaagtaccatcgctgcgtcagcggcgggaagatattcctctgctggcaaaccattttcttcagcgctttgccgaacgtaatcgcaaggcggtaaaaggctttacgccccaggcgatggatctgctgattcattacgactggccgggaaatattcgtgaactggaaaacgcggtggaacgggcggtggtgctgctgaccggggaatatatttccgaacgcgagctgccgctggcgattgccagtacgccgatcccgctggtacaaagtcaggatattcagccgctggtggaagtcgaaaaagaggtgattctggcggcgctggagaaaacaggcggcaacaaaaccgaagccgcccgccagttagggatcacgcgcaaaacgctattggcaaaactgtcgcgttagttctgctcgcgttcgatagcgcgccagccgatatctttccggcagaagcagtcgtcccaatggatatcggtcattaaggcataagcgcgtttctgcgcttctgccacggtatgacccagcgcggtaacgcacagtacgcgcccgccgctggtcactacctgctcgtcatccgctagtttcgtgcccgcgtggaacactttgccgtctgccacttcttccagcggcaggccgtggatcacatcgccggtgcggtaatcgcccggatatccacccgcagccatcaccacgccgagagaagcgcgttcatcccactcggacgttttctcgtccagcttgccttcacaggccgccaggcagagctcaaccagatcggacttcatgcgcagcataatcggctgggtttccggatcgccaaagcggcagttaaattcaataaccttcggattgccctgtttgtcgatcatcaggcccgcgtagagaaaaccagtgtaggtgttgccttccgccgccatgcctttcacggttggccagatgatacgctccatcgtgcgctgatgaacctcatcggtcactactggcgcaggggagtaagcgcccatcccgccggtgttcggcccggtatctttatcgcctacgcgtttgtgatcctggctggtggccatcggcagcacatgctcgccgtccaccatcacgatgaaactggcttcttcgccgtcgaggaattcttcgatgacgatgcgatggcccgcatcgccaaacgcattgcccgccagcatgtcgtgaacggcggcttcggcttctgcgagcgtcatcgccacaatcacgcctttcccggcggccagaccgtcagccttgatgacgatcggcgcgcctttctcgcgcagataggccagcgcaggctcaacttcggtaaagttctgatattccgccgtcgggatctgatgacgcgcgagaaaatctttggtgaaggctttggaaccttccagttgtgcggcaccttcggttgggccgaagattttcagacccgcggcacggaaggtatccaccacgcctttgaccagcggcgcttccgggccaacgatggttagatctaccttttcgttttgtgcgaaatccagcagcgccgggatatcggttacgccgatagcgacgttctgtagcgcgggttccagcgcagtgcctgcattacccggagcaacaaaaacagtttcaaccagcggcgactgagccgctttccaggccagcgcgtgctcgcgcccgccgttaccaatcactaatactttcatctattgctccattaatggcggaagtggcgcatgtcggtgaagagcatcgcaataccgtgctcgtcggcggcggcaatcacttcgtcatcacggatagaaccgccaggctggattacacaggtcacacccgcagcggcggcggcatcaataccgtcgcggaacgggaagaacgcgtcagaagccattgacgaacctttcacttccaaaccttcatcggcagctttgataccggcgattttcgcggagtacacgcggctcatctggcctgcgccaataccgatggtcatattgtttttggcatagacgatagcgttggatttcacgaacttcgccactttccagcagaacagcgcatcacgaagttcctgttcagtcggctgacgtttggtgacgacgcgcagttcttctgcaccgaccatccccaggtcgcgatcctgaaccagcagaccgccgttcacgcgtttgaaatcaagacccggagcacgctcgccccactgaccgcagatcaggacgcgaacgttctgtttagcggcggttattttcagggcttcttcgctggcggacggcgcaataatcacttcaacaaactgacgagaaatgatggcctgcgcggtttccgcatccagctcgcggttaaaggcgataatgccgccgaatgcggaggttgggtcggttttatacgcgcgatcgtaagcatcgagaatggagttgctgaccgccacgccgcatgggtttgcatgcttcacgatcacacaggccggctcggcgaactcttttacgcactccagcgccgcatcggtatcggcgatgttgttataagagagggctttaccctgaacctgggttgcggtggcaacggaggcttctttcacattctcttctatatagaaggcagcctgctggtggctgttctcgccgtagcgcatatcctgcttcttgatgaagttcaggttcagcgtacgcgggaagcgaccggcggcttctttgctttcaccgtgataggccggaaccatgctgccgaagtagttggcaatcatgctgtcgtaggcggcagtgtgttcgaaggctttgatggcaaggttgaaacgggttgcaagcgtcagcgatccttcgttggcatccatctctttaataatggcgtcgtagtcgctactcttcaccacgattgcgacatctttatggttcttggcggcggagcgcaccatcgttgggccgccgatatcgatgttctcaaccgcatcttccagcgagcagccttcacgagcgacggtctgggcgaacggatacaggttaacaaccaccatatcgataggctggatctgatgttcttccataatggcatcgtcctggccgcgacggcccagaatgccaccatgtactttcggatgcagggtcttcacgcgtccatccatcatctccgggaaaccggtgtaatcggaaacttcggttaccggcagacctttttctgctaacagacgggcagtgccccctgtagacagcagctccacaccgcgtgcggaaagtgcctgggcgaattcgacgataccggctttgtcagaaacactgagcagagcgcggcggactggacgacgttgttgcatggtaaatcccctggatttgactattacagagagcgttagctgaatttttcgcgaaaaactcagctaacgcccctaacggggcatccttatttttcgcccgcattgtaacgaaaacgtttgcgcaacgctcgcgaatttttctctttcaatggtgatcacaattttgacagtggctaccgtgggaaaaatacagaaattacattgaagattgtggataactctgtgcgtaaaaaggtataaagcggggttttgctggggaatgcagcagtcagtcatttttatgcaatttttctattgcggcctgcggagaactccctataatgcgcctccatcgacacggcggatgtgaatcacttcacacaaacagccggttcggttgaagagaaaaatcctgaaattcagggttgactctgaaagaggaaagcgtaatatacgccacctcgcgacagtgagctgaaagccgcgtcgcaactgctctttaacaatttatcagacaatctgtgtgggcactcgaagatacggattcttgacgtcgcaagacgaaaaatgaataccaagtctcaggagtgaacacgtaattcattacgaagtttaattctttgagcatcaaacttttaaattgaagagtttgatcatggctcagattgaacgctggcggcaggcctaacacatgcaagtcgaacggtaacagaaagcagcttgctgctttgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgtactttgaagtgctcacacagattgtctgatagaaagtgaaaagcaaggcgtcttgcgaagcagactgatacgtccccttcgtctagaggcccaggacaccgccctttcacggcggtaacaggggttcgaatcccctaggggacgccacttgctggtttgtgagtgaaagtcacctgccttaatatctcaaaactcatcttcgggtgatgtttgagatatttgctctttaaaaatctggatcaagctgaaaattgaaacactgaacaacgagagttgttcgtgagtctctcaaattttcgcaacacgatgatgaatcgcaagaaacatcttcgggttgtgaggttaagcgactaagcgtacacggtggatgccctggcagtcagaggcgatgaaggacgtgctaatctgcgataagcgtcggtgaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgcgcgatacagggtgacagccccgtacacaaaaatgcacatactgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcctcttaatggggtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacactatgtgttgttgggtaggggagcgttctgtaagcctgtgaaggtggcctgtgagggttgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaaccaaggctgaggcgtgatgacgaggcactacggtgctgaagcgacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagcggcaacgcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttggcccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagacttagagtctcctgaaggaacgttgaagacgacgacgttgataggccgggtgtgtaagcgcagcgatgcgttgagctaaccggtactaatgaaccgtgaggcttaaccttacaacgccgaagatgttttggcggatgagagaaagattttcagcctgatacagattaaatcagaacgcagaagcggtctgataaacagaatttgcctggcggccttagcgcggtggtcccacctgaccccatgccgaactcagaagtgaaacgccgtagcgccgatggtagtgtggggtctccccatgcgagagtagggaactgccaggcatcaaattagaaaaaccccggtcaataaggccggggttttttgcatatcaattatttgcatgatgaagggaatctcatgtcagttctgtatatccaaattcgtcgtaatcaaattactgttcgcgatcttgaaagcaaacgtgaagtgtcaggagatgctgccttcagtaaccagcgcctgttaatcgccaatttctttgttgcagaaaaagttctgcaagatcttgttctgcaactccacccacgttcaacctggcattcttttttgccagcaaaacgtatggatattgttgtgagcgcgctggaaatgaatgagggcggtttgtcacaggttgaggaacgcattcttcatgaagtggtcgcaggggcaacgttaatgaaatatcgccagttccacatccatgcgcaatcagtggtactcagtgatagtgcggtcctggcaatgtttaagcagaaataatcatgtcaccattggtgggtacgaaacctaaagttcagcccaccgggatgagaaaaaaccgcctacgcccccacatatgccagattcagcaacggatacggtttccccaaatcgtccacctcagagcgtcccgtaaccttaaagcccaccttcttatagaacccaaccgcctgctcattttgctcattaacattggttgtcagttccggggccattgatagcgcatgcttcaccagcatccggcccacgccgcagccgcgcacatcaggatcgataaacagcacatccatatgctgcccacttaacaacataaacccaaccggctgctcccgctcattaaccgcgacccacaacggtgcttccggcagaaaggaatgcaccagctcttccagctcggcccgatactctgctgataaaaaatcgtgagtggcatcgacagaacgacaccaaatcgcaacgagttcctccccctcctcatgccgtgagcgtcgaatactaataaccattttctctccttttcgtcattcttatattctaacgtagccttttccttgaaactttctcaccttcaacatgcaggctcgacattggtaaattttctggttatcttcagctatctggatgtctaaacgtataagcgtatgtagtgaggtaatcaggttatgccgattcgtgtgccggacgagctacccgccgtcaatttcttgcgtgaagaaaacgtctttgtgatgacaacttctcgcgcgtctggtcaggaaattcgtccgctaaaggtgcttatccttaacctgatgccgaagaagatcgaaactgaaaatcagtttctgcgcctgctttcaaactcacctttgcaggtcgatattcagcttttgcgcatcgattcccgtgaatcgcgcaacacgcccgcagagcatctgaataacttctactgtaactttgaagatattcaggaacaaaactttgacggtctgatagttaccggcgcgccgctgggcctggtggagtttaatgatgtcgcttactggccgcagatcaaacaggtgctggagtggtcgaaagatcacgtcacctcgacgctgtttgtctgctgggctgtacaggccgcgctcaatatcctctatggtattcctaagcaaacccgcaccgacaaactctctggcgtttacgagcatcatattctccatcctcatgcgcttctgacgcgtggctttgatgattcattcctggcaccgcattcgcgctatgctgactttccggcagcgttgattcgtgattataccgatctggaaattctggcagagacggaagaaggggatgcatatctgtttgccagcaaagataagcgcattgcctttgtgacgggccatcccgaatatgatgcgcaaacgctggcgcaggaatatttccgcgatgtggaagccgggctagacccggatgtaccgtataactatttcccgcacaatgatccgcaaaatacaccgcgagcgagctggcgtagtcacggtaatttgctgtttaccaactggctcaactattacgtctaccagatcacgccatatgatctacggcacatgaatccaacgctggattaatcttctgtgatagtcgatcgttaagcgattcagcactttacctcaggcaccttcgggtgccttttttatttccgaaacacacctcagcaagtgaataaattttatttatattgttatcaataagttaacatgcatttttaattaaaatggaaattgtttttgattttgcattttaaatgagtagtcttagttgtgctgaacgaaaagcgcacaacgatccttcgttcacagtggggaagttttcggatccatgacgaggagctgcacgatgactgaacaggcaacaacaatcgatgaactggctttcacaaggccgcatggcgagcaggagaagcaaattcttactgccgaagcggtagaatttctgactgagctggtgacgcattttacgccacaacgcaataaacttctggcagcgcgcattcagcagcagcaggatatcgataacggaatgttgcctgattttatttcggaaacagcttccattcgtgatgctgactggaaaattcgcgggattccttcggacttagaagatcgtcgcgtagagattaccggacctgtagagcgcaagatggtgatcaacgcgctcaacgccaatgtgaaagtctttatggccgatttcgaagattcactggcaccagactggaacaaagtgatcgatgggcaaattaacctgcgcgatgcggttaacggcaccatcagctatagcaatgaagcaggcaaaatttatcagctcaagcccaatccagcggttttgatttgtcgggtacgcggtctgcacttgccggaaaaacatgtcacctggcgtggtgaggcaatccccggtagcctgtttgattttgcgctctatttcttccacaactatcaggcactgttggcaaagggcagcggtccctatttctatctgccgaaaatccagtcctggcaggaagcggcctggtggagcgaagtcttcagctatgcagaagatcgctttaatctgccgcgcggcaccatcaaggcgacgttgctgattgaaacgctgcccgccgtgttccagatggatgaaatccttcacgcgctgcgtgaccatattgttggtctgaactgcggtcgttgggattacatcttcagttatatcaaaacattgaaaaactatcccgatcgcgtcctgccagacagacaggcagtgacgatggataaacccttcctgaatgcttactcacgcctgttgattaaaacctgccataaacgcggtgcttttgcgatgggcggcatggcggcgtttattccgagcaaagatgaagagcgcaataaccaggtactcaacaaagtaaaagcggataaatcgctggaagccaataacggtcacgatggcacatggatcgctcacccgggccttgctgatacggcaatggcggtattcaacgatattctcggctcccgcaaaaaccagcttgaggtgatgcgcgaacaagacgcgccgattactgccgatcagctgctggcaccttgtgatggtgaacgcaccgaagaaggtatgcgcgccaacattcgcgtggctgtgcagtacatcgaagcgtggatctctggcaatggctgtgtgccgatttatggcctgatggaagatgcggcgacggctgaaatttcccgtacctcaatctggcagtggatccatcatcaaaaaacgttgagcaatggcaaaccggtgactaaagccttgttccgccagatgctgggcgaagagatgaaagtcattgccagcgaactgggcgaagaatgtttctcccaggggcgttttgacgatgccgcacgcttgatggaacagatcaccacttccgatgagttaattgatttcctgaccctgccaggctaccgcctgttagcgtaaaccaccacataactatggagcatctgcacatgaaaacccgtacacaacaaattgaagaattacagaaagagtggactcaaccgcgttgggaaggcattactcgcccgtacagcgcggaagatgtggtgaaattacgcggttcagtcaatccggaatgcaccctggcgcaactgggcgcggcgaaaatgtggcgtctgctgcacggcgagtcgaaaaaaggctacatcaacagcctcggtgcactgactggtggtcaggcgctgcaacaggcgaaagcgggtattgaagcagtctatctgtcgggatggcaggtagcggcggacgctaacctggcggccagcatgtatccggatcagtcgctctatccggcaaactcggtgccagcggtggtggagcggatcaacaatactttccgccgtgcggatcagatccaatggtccgcgggcattgagccgggcgatccgcgctatgtcgattacttcctgccgatcgtcgccgatgcggaggccggttttggcggtgtactgaatgcctttgaactgatgaaagcgatgattgaagccggtgcagcggcagttcacttcgaagatcagctggcatcagtgaagaaatgtggtcacatgggcggcaaagttttggtgccaactcaggaagctattcagaaactggtcgcggcgcgtctggcagctgatgtgacgggcgttccaaccctgctggttgctcgtaccgatgccgatgcggcggatctgattacctccgattgcgacccatatgacagcgaatttattactggcgagcgtaccagtgaaggcttcttccgtactcatgcgggtattgagcaagcgatcagccgtggcctggcgtatgcgccatatgctgacctggtatggtgtgaaacctccacgccggatctggaactggcgcgtcgctttgcacaagccatccacgcgaaatatccgggcaaactgctggcttataactgctcgccgtcgttcaactggcagaaaaacctcgacgacaaaactattgccagcttccagcagcagctgtcggatatgggctacaagttccagttcatcaccctggcaggtatccacagcatgtggttcaacatgtttgacctggcaaacgcctatgcccagggcgagggtatgaagcactatgttgagaaagtgcagcagccggaatttgccgccgcgaaagatggctataccttcgtatctcaccaacaggaagtgggtacaggttacttcgataaagtgacgaccattattcaaggtggcacgtcttcagttaccgcgctgaccggctccaccgaagaatcgcagttctaagcaaccgataaacgttgctgactgtaggccggataaggcgttcacgccgcatccggcaatcagcgcctgatgcgacgcttgcgcgtcttatcatgcctacagccgttgccgaacgtaggccggataaggcgtctacgccgcatccggcaatcagcgcctgatgtgacgcttacgcgtcttatccggcaattctctgctcccgacgagggcaacaaatgccgcgtggcctggaattactgattgcacaaaccattttgcaaggtttcgacgctcagtatggtcgattcctcgaagtgacttccggggcgcagcagcgtttcgagcaagccgactggcatgctgtccagcaggcgatgaaaaaccgtattcatctttacgatcatcacgtgggtctggtcgtggagcaactgcgctgcattactaatggccaaagcacggacgcggcatttttactgcgcgttaaagagcattacacccggctgttaccagattacccgcgtttcgagattgcggagagctttttcaactccgtgtactgtcggttatttgaccaccgctcgcttactcccgagcggctttttatctttagctcccagccagagcgccgttttcgtaccattccccgcccgctggcgaaagactttcaccccgatcacggttgggaatctctgctgatgcgcgttatcagcgatctgccgctgcgtctgcgttggcagaataaaagccgtgacattcattacatcgttcgccatctgacggaaacgctggggacagacaacctcgcggaaagtcatttacaggtggcgaacgaactgttttaccgcaataaggcagcctggctggtgggcaaactaataacgccttccggcacgttgccatttttattgccgatccaccagacggacgacggcgagttatttattgatacctgcctgacgacgaccgccgaagcgagcattgtttttggctttgcgcgttcttattttatggtttatgcaccgctgcccgcagcgctggtcgagtggctacgggaaattctgccaggtaaaaccaccgctgaattgtatatggctatcggctgccagaagcacgctaaaaccgaaagctaccgcgaatatctcgtttatctacagggctgtaatgagcagttcattgaagcgccgggtattcgtggaatggtgatgttggtgtttacgttgccgggttttgatcgggtatttaaagtcatcaaagacaggttcgcgccgcagaaagagatgtctgccgctcacgttcgtgcctgctatcaactggtgaaagagcacgatcgcgtgggccgaatggcggacacccaggagtttgaaaactttgtgctggagaagcggcatatttccccggcattaatggaattactgctccaggaagcagcggaaaaaatcaccgatctcggcgaacaaattgtgattcgccatctttatatcgaacgacggatggtgccgcttaatatctggcttgagcaagttgaggggcagcaattgcgtgatgccattgaagagtacggcaacgccattcgccagcttgccgctgccaacatcttccctggggatatgttatttaaaaactttggcgtcacccgtcacgggcgcgtggtgttttatgattacgacgaaatttgctacatgacggaagtgaatttccgcgacatcccgctgccgcgctacccggaagacgaacttgccagcgaaccgtggtacagcgtctcgccgggcgatgttttcccggaagagttccgtcactggttatgtgccgacccgcgtattggtccgctatttgaagagatgcacgccgacttgttccgcgctgattactggcgcgcactacaaaaccgcatacgtgaagggcatgtggaagatgtttatgcgtatcggcgcaggcagcggtttagcgttcgattcgtataaatcagaggcgaaaaagtcagcgtattccaccgtacgacagcgtcacttccttcgccgctttaatcaccatcgcgccaaactcggtcacacggtcatcggtaatacgtgaaatcggtccggaaattgaaattgcggcaaacggttcgcggtgctcatcgaaaatacacgctgcaaggcaacgcagccccagcgcatgttcctcatcgtcaaatgaataaccccgtttgcgcgtttgggcgagatcttcttttaaatgcacaggagacaccagcgtcgcgtgggtataggcatgtaaccctttgcggtgcagcagcttcgtcacctgttcttcgctcagttgggccagaaaggctttacccgcaccggaagcgtgcatcggcaatttaccgccgataggcgcggacattcgcatcaggtgagtacactgtacctggtcgataataatcgcttcgtgatcgctttgatcaagcaccgccatattgaccgtttcgccagactcttccattagattgcgcaggatagggtgaacaatcgctaacaaattacggctctggagaaagctgctgccgaccataaaggcgtgtgcgccgatcgcccagtgacccagttcgccgacctgacggacaaagccctgctgttgcatcgaggttagcaggcggtgggtcgtggaattgggtaacccggcttgctgtgccagttccgtgagtgccacactgccattggattcggcaatccactccagtaatttcaggccacgcgttaaagactgaacctgtccagtcgctggtgcggtggcaacggcgggttttctgccgcgttttgcgggaatgggtgcgaccatgacagtctcctttttctgtatcgtggaaatcattttcatttttattatcagcgaatgcaatagttgctgaacagatccgatgagttaatgttgaacaaatctcatgttgcgtggtggtcgcttttaccacagatgcgtttatgccagtatggtttgttgaatttttattaaatctgggttaagcgtgtcgggagcaagtgtgagcagcaaagtggaacaactgcgtgcgcagttaaatgaacgtattctggtgctggacggcggtatgggcaccatgatccagagctatcgactgaacgaagccgattttcgaggtgaacgctttgccgactggccatgcgatctcaaaggtaacaacgacctgctggtgctcagcaaaccggaagtgatcgccgctatccacaacgcctactttgaagcgggcgcggatatcatcgaaaccaacaccttcaactccacgaccattgcgatggcggattaccagatggaatccctgtcggcggaaatcaactttgcagcggcgaaactggcgcgcgcctgtgccgacgagtggactgcccgcacgccggagaaaccgcgctacgttgccggtgttctcggcccgaccaaccgcacggcgtctatttctccggacgtcaacgatccggcattccgcaacatcacttttgaccagctggtggcggcttatcgagaatccaccaaagcgctggtggaaggtggcgcggacctgatcctgattgaaaccgttttcgacacccttaacgccaaagcggcggtctttgcggtgaaaacggagtttgaagcgctgggcgttgaactgccgattatgatctccggcaccatcaccgacgcctccgggcgcacgctctccgggcagactactgaagcgttttacaactccctgcgccacgccgaagcgctgacctttggcctgaactgtgcgctggggccagacgaactgcgccagtacgtacaggaactgtcgcgtattgcggaatgctacgtcaccgcccacccgaacgccgggctgcccaacgcctttggtgaatacgatctcgacgccgacacgatggcaaaacagatacgtgaatgggcagaagcaggctttctcaatatcgtcggcggctgctgcggcaccacgccacaacatattgcagcgatgagtcgtgcagtagaaggattagcgccgcgcaaactaccggaaattcccgtagcctgccgtttgtccggcctggagccgctgaacattggcgaagatagcctgtttgtgaacgtgggtgaacgcaccaacgtcaccggttccgctaagttcaagcgactgatcaaagaagagaaatacagcgaggcgctggatgtggcgcgtcagcaggtggaaaacggtgcgcagattatcgatatcaacatggatgaagggatgctcgacgccgaagcggcgatggtgcgttttctcaatctgattgccggtgaaccggatatcgctcgcgtgccgattatgatcgactcctcaaaatgggacgttattgaaaaaggtctgaagtgtatccagggcaaaggcattgttaactctatctcgatgaaagagggtgtcgacgcctttatccatcacgcgaaactgttgcgtcgctacggtgcggcagtcgtggtaatggcttttgacgaacagggccaggccgatacccgcgcacggaaaatcgagatttgccgtcgggcgtacaaaatcctcaccgaagaggttggcttcccggctgaagatatcatcttcgacccgaacatcttcgcggtcgcaactggcattgaagagcacaacaattacgcgcaggactttatcggcgcgtgtgaagacatcaaacgtgaactgccgcacgcactgatttccggcggcgtttctaacgtttctttctcattccgtggcaacgatccggtgcgcgaagccattcacgcggtgttcctctactacgctattcgcaatggcatggatatggggatcgtcaacgccgggcaactggcgatttacgacgacctgcctaccgagctacgcgacgcggtggaggatgtgatcctcaaccgtcgcgacgatggcaccgagcgtttactcgagcttgccgagaaatatcgcggcagcaaaaccgacgacaccgctaacacccagcaggcggagtggcgctcgtgggaagtgaataaacgtctggaatactcgctggtcaaaggcattaccgagtttatcgagcaggataccgaagaagcccgccagcaggctacgcgtccgattgaagtgattgaaggcccgttgatggacggcatgaacgtggtcggcgacctgtttggcgagggcaaaatgttcctgccgcaggtggtgaaatcggcgcgcgtaatgaagcaggcggtggcgtatctcgaaccgtttattgaagccagcaaagagcagggtaaaaccaacggcaagatggtgatcgccaccgtgaaaggcgatgtccacgacatcggtaaaaatatcgttggcgtggtgctgcaatgtaacaactacgaaattgtcgatctcggcgtgatggtgcctgcggaaaaaattctccgtaccgctaaagaagtgaatgctgatttgattggcctttcagggctgatcacgccgtcgctggacgagatggttaacgtggcgaaagagatggagcgtcagggcttcaccattccgctattgattggcggcgcgaccacctcaaaagcgcacacggcggtgaaaatcgagcagaactacagcggcccgacggtgtatgtgcagaacgcatcgcgcaccgttggtgtggtggcggcgctgctttccgacactcagcgcgatgatttcgttgctcgtacccgcaaggagtacgaaaccgtgcgtattcagcacggacgaaagaaaccacgcacaccaccggtcacgctggaagcggcgcgtgataacgacttcgcttttgactggcaggcttacacgccgccggtggcgcaccgtctcggtgtgcaggaagtcgaagccagcatcgaaacgctgcgtaattacatcgactggacgccgttctttatgacctggtcgctggccgggaagtatccgcgcattctggaagatgaagtggtaggtgttgaggcgcagcggctgtttaaagacgccaacgacatgctggataaattaagcgccgaaaaaatgctgaacccgcgtggtgtggtgggcctgttcccggcaaaccgtgtgggcgatgacattgaaatctaccgtgacgaaacgcgtacccatgtgattaatgtcagccaccatctacgccaacagaccgaaaaaaccggcttcgctaactactgtctcgctgacttcgttgcgccgaaggtttccggcaaagcagattacatcggcgcatttgccgtgactggcgggctggaagaggacgcactagctgatgcctttgaagcacagcatgatgattacaacaaaatcatggtgaaagcgcttgccgaccgtctggcggaagcctttgcggagtatctccatgagcgtgtgcgtaaagtctactggggctatgcgccgaacgagaacctcagcaacgaagagctgatccgcgaaaactaccagggcatccgtccggcaccgggctaccctgcctgcccggaacatacggaaaaagccacaatctgggagctgctggaagtggaaaaacataccggtatgaaactcacggaatccttcgccatgtggccgggtgcatcggtttcgggttggtacttcagtcatccagacagcaagtattacgcggtggcgcaaattcagcgcgatcaggttgaagactatgcccgccgtaaaggaatgagcgttaccgaagttgagcgttggttggcaccgaatctggggtatgatgccgagtaagtgataacaccggggtatttgccccggtttttaatgtcataaataatggattattgaacatgataaaaattgatgaaatagatttttttgctttcgaaggatgttcagagtccgaagttactgaactattaggaaaaaaaccaacaggttataatgattggataattaatataaaaacaggtgtggagtgggtattttatgatggtcgttattggttagattttcgtaaatccaaagagggtataaggtgtatctcatgcagtattctgtatcacgataaaagtaaagggcgtatcgatgtcttgtttagtgaaggtatagctgacagaggtttaaaaaatacgggtggagtgttaatccaaaaacgcccgcaattataataattcctggtaatatttgttttcgtaaaaaggatttactttatgcaacgtcaatataaaaaatacattcttcttttttggggtgttatggatgttatcgcgatagccacatatctgttctactcgcttggtaatggtcgtatccctttttattccgatatcgttcattcactttctttacttaaggatatcggtgttgaaggcggtttttacgcttatgcagtcgccactgttacgctacaaatagtattattgttctctttattcttttctgcgcaatgttttttaagacaaaaattatttagtttctcttttttggcgattcaggagtttatgcgttttgctaccgtaagctgttcaatctccgtaataccgttgttacttaattatttttattcacaggatctggtcttaaatatttcgttgtttatcttctcagaggtcacaaaagtgacaacgattatctggtgtaaacgacaggggaaagtgtgacaaaaatagcaacagatacaggtggatttttatataaatgcctttttaaatgctttcttgtataaatctcttatactgaaagtacatacaagagaaatgcctggataaaaacaacgtgattagaaaaatcttaacaggaaaatgcataacaaaaaggagaacctgattccgtgctaactttgcttcacctgctttctgccgtcgccctgctggtctgggggactcatattgttcgaacaggcgtaatgcgcgtcttcggcgcgcgtctgcgtactgtccttagccggagcgtcgaaaaaaagccgctcgccttttgcgcggggatcggcgttaccgcactggtgcagagcagtaatgccaccaccatgctggtgacctcgttcgtcgctcaggatctggttgctctcgcgcctgcgctggtgattgtgctgggtgcagatgtcgggacggcgctgatggcgcgtattctcaccttcgatttatcctggctgtcaccgttacttatttttatcggcgtgatttttttcctcggacgcaaacagtcacgcgccgggcaactgggccgcgtcggtattggtcttgggctgattttactggcgctggagttgattgtgcaggccgtaacgccgatcactcaggcaaacggcgttcaggtgatctttgcctcgctgactggcgacattttgctggatgcgctgattggtgcgatgttcgccattatcagctactccagccttgccgcggtactgctgaccgcgactctgaccgccgcaggcattatctctttcccagtggcgctttgtctggtgattggtgcaaacctcggttccggcctgctggcgatgctcaacaacagtgccgccaatgccgcagcccgccgtgtcgcgctgggtagcctgctgtttaagctggtgggtagcctgattatcctgccgtttgttcatttgctggcagagacaatggggaagttgccattgccaaaagcggaattggtgatctatttccacgtcttctacaaccttgtacgctgcctggtcatgttgccattcgttgacccgatggcacggttttgcaaaacgattattcgcgatgaaccggaactggatacccagctacggcctaaacatctggatgtcagcgcgctggatacgcccacgcttgctctggcgaacgctgcccgcgaaaccctgcgcattggcgacgccatggaacagatgatggaagggctgaataaagtgatgcacggcgagccacggcaggagaaagagctgcgtaagctggctgatgacatcaacgttctctataccgccattaagctgtatctggcgcggatgccaaaagaggaactggcagaagaagagtcgcgccgctgggcggagatcatcgaaatgtcgctcaaccttgaacaggcctccgatatcgtcgagcgcatggggagtgaaattgccgacaaatcgctggcagcaaggcgagcattttcgcttgatggcttgaaggaactggatgcgctctatgagcaattgctcagtaatttaaaactggcaatgtcggttttcttctctggcgatgttaccagcgcccgtcgtttgcgccgcagcaaacatcgttttcgcattcttaatcgccgctattcccacgcccacgtcgatcgcctgcaccagcaaaacgtgcagagtattgaaaccagttcgctacatttaggcttactgggagatatgcagcgtctgaactcgctgttttgttcggtggcttacagtgtgttggaacagccggatgaagatgaaggacgggacgagtattaatatcgtgaccctgaaggcctgataagacgcgtaaagcgtcgcatcaggcactatgaacaagatgccggatcatgcatccggcaattcacttaaaaacggtgacccacttccagcggcaccgcttcttcaccagccttaaacacataagtggtgttcgggccacccagcgtagcgtgacctttacttactgtgatccagttaccttccggcagaccaataatcgtcagttctggcgcgacgaccagcagttcgcgaatacgctgctcacgggtttcacctttatggccttccggcagcgcgttggtgaagtgcgggttgatttgtagcgggaacagatttagcgcatcgaaaccttgcggatcgacaatcggcatatcgttggtggtacgaatggttgggcaagcaaggttagcgcctgcgctccagccaatatacagcgcgccacgtttcaccacgtcagtaattggtgccagcagcccgcgctcgcggcactgtttcagcaactggaaagtattaccgccgccgacaatcacaatttccgcattttcaatcgcggcaacgggatcgacaacgctatgaataccggtgacagaaacacccagcggagcgagaaccgcagccgttttcgctgtgtaatcatcccaggtctgcgttacgccagcgaaaggaataaataccgcagaacggcgaccctgcaactgttcagcaatcagcggcagcgcgtgttccagccaggctttacccggcagcgtcgagttactcaataaaagcagttccattacttctccggttagtaagaaaacacggaaggaatgctaccactgcgaatttaaccacttactgacatggctcacgatgtcacatattgcacaggcgctgagactgatgacaaacacaggattgcctgatgcgctacgcttacctggcctaccagataactgcaatatattgaattttcaagattatgtaggccgaataaggcttcattccgtatccggcataaacaatgtgcactttgccaccaatttgagcgccccttaaggcgctgatgtttttttatccttctcgtgcacattgtgccgcttcagcaatcagccgcacatcaggtcgcgaagttgccgcggcgaccagccagcgacatgcagagttaagtagcgcgattaatcatgggaaattgcctctgcatgggcgagcaggtattgctccgcctcaccggaccagatcccctgatgatgcgccagaatcaccgccagtgcttgatcctgaatctgcgtgagtgacgtcagcggcaggtatttcccggtatacaccagctttttgccgccgccgatggcaggcaattcaagcgtggtttcgcccgcggcattcagcccaagaatatgtgttaccacttttgcggcctgcacttttttctcttcaatcaatttgaccgctgcgcgcatgtcgtcggtattgccgcctgatgtgcccacgtagtgggtaaatgcataatgcacatcgtagaaattaattggcgcgctgaagtgcttatcctgcggtccggcgaagaaattcagacaaccatctgtcgccagcaaggaaaaggcgagagtcaccagtccttcattaggcacaaagacgaaaatatcatcgaagccgtgaccgccactcagtgccattaacgtatcaaatgctgcatcggtggcattgagataatgaatcagtgtttgcggttctgatggatagtgcttgcgcgcataactcaatttgtcgttgtcggtatcggtaatgacgagcagcgaagggttaacgggtccatgtagcgcataatcaatcgccagcagccccatcgggccggtgccgccgaggatcagcgtgcgcccttgcgggcgaatccccatcgtgtggttataactaccttcctgaagatgatagttggcgttgaacgcgccaatcacgcaggaaagcggttcaaccagcgagccttcaaaataggtttcgccgtcgtatgccagcaggcaatcttgttccatgacctcgttgggaataaccacatgcgtcgcttcgccgcctacccacgggaaggagtagccggggcaatccgggcggtcggggagttgcaggttggcctgaatcacataacgctgacccggctggaatttgtgctgccactttttacccacggccagaatatcgccgcaaaattcgtggccgatgatgatgggattggtcgccacatcgtcgggtacttttttatggttttcacccagattggcctctttccaggaagagaggcacaggctgtcagtgaccaccgttgcgaggatttcatcctcctgcatttcaggaaggtcaaaggtttccagacgcaggtcacgtttgccataaagacgcagagctgttgttttcataaaccacctcatgttgaacgatggccccgacggttgcgccggggcgaagaatcaggacaggaagcccagcgcattaccgataatccctaaaccaaacagggcgaaaatcagccataccgggttaatttttttgttgagcagacgaaccatcagcagcgtcagaccgagcgccagcaaaccagggcaaagttggtcgaggatgttctgtacggttatggtgacggtggcaccatcggcggcaggcgtttgtgaaaccaccaacggtacgttgattgacgtccatttggtcaccagcacgcccatcacaaacagcccgagaatcgacgcgccttcggtgagtttttgcagcaaattaccgcccatatcgctgacgatattcacccctttgcgaaagccgagctgtaggccataccacttcatcgccagacgcaccgcgttgaaaataaagaagaacagcagggggccgagaatgttgcccgaaagtgccagagatgcgccgagcgcggcggtaatcgggcgcagcgttccccagaccagtggatcgccaactcctgccaatggtcccatcagaccgactttgatgccgttaatggtaccgtcatcaatttccgcgccgttggctcgcgcctcttccatggcggcagtgacgccgatgaccgggccacatacggctggcgtggtattgaagaacaccaggtgtcgcctgagcgccgcaacctgatcctcttttaatgggtaaagtcgtttgatggcggggatcatgtcgtagcaaaaacccagcccgtgaatacgttcaaagttaaaggatgcctgttgcaggttggagcgcagaaacatgctcaccagatcgctgcgtgtaatttttctctgttccatgatggctccgttaatcatcaagttggtcaagggcggtgatagtggtggtctggggatgtggttcagctttacgccactgtggatttaactggatgtagagcagggccatgatcacgccgacgccaccgaacgccagcagactgagatcgaggtagccacctgcgaggaaaccgaggaaaaagaaaggcatcaaatatttcacgcccatcatgcgaagcaccatggcgtaaccgaccaccacgataaaaccgccagcaatctgcagtccacgggtcacaaattcgggaatggcgctcagcatattgctcaccatatcagcgctgacgaacagcgagacaatcagtgccggaatagcaacgcgcagtgcctgcacgccaagcgcggagacatgcagaatatcgagagtgcgaaaccgtgcttcttccgctgctttatccgccgcgtgctggaacactacggtgatggtacgggcaaacaccgtcagcacctggcctgcagcagccacaggcaacgcgatggcgattccggtggcgatgctttgctgaccaacgataaccagaatggcggagattatgctggcgagtgcagaatccggagattgcgccgcgccgacgttcatccagccgagagctatcaattccagcgtaccaccgagcataattccggtttttaaatcaccgagaattaaaccaatcaccgtacaggcaattaacggacgatgagtctgaaattcatccagcacgctgcccattccggcaatacaggaaaaaagaaatatagcaatgatttgtagggtacttatttccatgatttgtcaccttttaagtgtcgtcatccctgcctgttaaagcatatgtacacaggcgctattatttaattcgcgattaactgttcgtttattttgtcgataatattgattgagggatctgacgctacgacgcgtaaatccagtatgacgccaagattatttaactcatgaaatgcgttaatatcatcgtcatctaatgaaactgctttggttaactgttttttaccaggacgccaggccataccgccaatattcagggtacctatttttaccccctggcgaaccattgctaaggcatcctgtgggcgagtgaaaagataaaaaacggtttcgtcctgatattgcgggttgtgatacaccgcgacggctttttcaatattgaccacgttaaccttcattcccggtggcgcagcctgacgcaataatgtccggcgaacttcatcgttataaacttcgtcattgcagataataatgcgctgggcgttagccactttagaccagacggtagtgacctggccgtggatcaggcggtcatcaatgcgggcgagcgtaatgttcatcagaaatcctcctccgctgttgccacctgtctccagacgacgcaggtttgctttgcgatttgcgtcaggtgttcacacagttcatcaacattcatgctgtcctggttatcaaccagttcgagcgccagcggcagagaaaggccgctgattacccgcagacgaggattgcgcatcgcaagcatcgctgccgcattccacgggctgccgcactgtaaatccacggcgattagccactcgtcatgattgtgaatgctcactaacttctccagctttgccacaatgtctccggcgttctcgccgggcacaaattcaactgcctcgaccctggcatcgccgtacaccatctgaaccgattccagcatggcgcaggctaatttgccgtgggcgcaaaaaatggcattgaccataaagcctccttagccgcgcgttttgccgcctgcaatgttagtggttactccggtgatatagctggcgcgttcagacagcagataacaaacaaaatcagccacttctgctaatcttccggcgcgcccaataggaatggaatttttggtatagccttcacgcagctgctcgacggtgatattgcgcgtccacgccagcgcctcttcatattccggcgtgcgcagccctgttttttccagaatccccggcgcgataccgaccacacggataccgtgcttacccagttctttcgaccaggagcgcgtgaagctattgagcgcggctttggtcgcggcgtaacagctttggccttctgagccttccagcccactttctgaggaaacattcacaatcacgccatcatgttgtttgaccatctgtcgcgccaccgcctgcgacatcagaaaaacgcctttctggttgatattgaccattttttcgaatgcagcttcgttgagttcatactgcccggcaggcactttctcatcgacaagcagacgcgggaaattgaccccggcgttgttaaccagaccgtcgatgcgaccaaaacgctggataatttctgctaccgtatgatttacctctttggcgctggaaatatcggtcggccagaactgataacctttatggctttcatattgaccatcgccaccgtgaatatcgaccatctgtacattcgcgccttgtgctaataattcctctacaatcgccagaccaataccggatgcgccaccggtgacaataatgattttatcctgcaaatttaaccacgtttgcataacagactcctgattttagataatagggacccgccgtaatttttattacggtaaacatcgggaagatttttatttcagtaatagttcagctgtgctgctattcgttaccagacaattaatatattttccacgcagtgcaccaacaattccgctgtatttttcttcgctcatggcaatgccaatggaataccgtgcctgctttaatttattcatttcgatagagagtgttttttcgctcatattcgtttcaaccattgcgccgtgaatatcaaaaaagcgcgagcaaatatcgccagcaacctggcgggcattcaggtcgtcactctcttcaccaccataaaacgcatgccagttagcgccgtcgcgaatggccggtgagccaattcccaccagggcgacatccagattatcccagtaggcagagatggttttaaagtgctgagactgcatgatcccattacgaattaatgggttatccagcagagccggaaaatccgcgagatgcgattcccctttcagcttcgctgccgcgctgtaggttaatgtgtttacgtgatagcggctttcgagtttaccggacgggccgccaataatcggcacgcaaattaactgccgcgattgccccgcctgcggcaagttttcaaccagtgcgctcaccgcgcggccccaggaaaaaccgacaatatcgccaggttccagcaagcgatccagcagttgcgcgccgtgtaaccccatcatcgccagttgagtatcttcatcctcatcatttcctgacaccaccacaacgtctttcaggctaaacttttgcttcacttgctgctccagccagagattttcgttgtagtcatagttgatggcgatggtgacaattccctgatcgcggcctcgtttaagcaagcggctgatggtggtgcggtaaatacccagttcgcgcgcaatttgcgcctgcgtcatatcctgttcgtaatagagttgggcaatcttcacaatcaaacggatatcgtcactgttttccattgccgcctcctggttctgcacatttgtgcaaatacgctttctcaccgcttgatctgatataaccccatcatgatggcctttcaaagcgatttttcactctttgcatggggggaaatagcgctttctcttgcacatttgtttctctgcgtagtagtcatcagcacaggtgtgcagcgatgcgtaatttgttgattattcttattttgccaggcaaatttgcatcgtacttccggagacacttttgtgataaaaggcgtggcagatcacatttaatttcgacgttgccgcataaccctgtttttccccgctaagaggtacggtatattccgcgttttacaggagaatttatgctgcccgactcatcagtccgtttaaataaatacatcagcgaaagcggaatttgctcacgccgcgaagcggatcgctatatcgagcaaggcaatgtgttccttaatggcaagcgagccaccattggcgatcaggtgaaacccggcgacgttgtgaaagtaaatggtcagttgattgagcctcgggaatccgaagatttggtacttatcgccctgaacaagcccgtcggtattgtcagcaccaccgaagatggcgagcgcgataacattgtcgatttcgttaaccacagcaaacgcgtgttcccgattggccgcctggataaagattcccaggggctgattttcctcaccaatcacggcgatctggtgaataagatcctccgtgcgggtaacgatcatgagaaagagtatctggtgacggttgataaaccgattaccgatgaatttattcgtggtatgggggcgggagtaccgatcctcgggacggtaactaaaaagtgcaaagtcaaaaaagaagcaccgtttgtcttccgcattaccttggtgcaggggctgaaccgtcagattcgtcgcatgtgcgagcactttggttacgaagtgaaaaagctggaacgtacgcgcattatgaacgtcagcttaagcggcattccgctgggtgagtggcgcgatttaaccgacgatgagttaatcgatctctttaagctcattgaaaattcctcttccgaggcaaaacctaaagcgaaggccaaaccgaaaacggtaggcatcaaacgtccagtcgttaagatggaaaaaacggcggaaaaaggcggtcgcccggcgtccaacggtaagcgttttacctcgccggggcgcaaaaagaaggggcgttaatcagcgtctgccgcgcgtcgacgtatttgctgaccagctaaatgacgcctcaggatccggtttataagcctgctttttcttcaattggcgggcttttttcgcttcagcctcacgctcgaccattaatttatcgatgtactctttcttaatgctgttagtttcggagttggtcagtacgcgaccatgcgcaatccgcgcccgatccagcagtgttttaagttcacgctgctcgcgttcagtcatctctttttgggtaatacgggggagtgccatgatggtgccctcagtgagccagagagttcagtgtacgggaattcgtttgcgagcagaactgataatattcattttgccttctcttaactatttatctctttcgataattagttagagatgcggataaaaaattaaaggcaattattctccgataaagacgctggttaacagggaatagactcgtttatttatgggcataatgacaagaaaaacaatacggcccgaaataatgtcttccgggccatactgtgtttactcaaacaaattaaaatgcagcttctgcactacctgctcggcatcttcgccgggcaccaggaagcacaggttatggctggatgcgccgtaacaaatcatgcgaatgttgaatggttccagtacgccgaatacctctttgccaacgccgcaggcttttgacaggtcattgccaatcaacgcgaccagcgccagaccctcttccacttccacccggcacagtgcggaaagctccatcagcagggattgcgtcagcaacgtatcgccagtggaggttgaaccggtggtatcaagggttaatgccacactcacttctgacgtggtgattaagtctaccgaaatattatgccgcgcgaggatgccgaaaacttccgcgaggaaaccgcgagaatgcagcatattcaggctgtgcaaagtgagcagagtctgattgcgacgaagcgccagcgcgcggaacagcggcggattttcagttttattgcacaccagcgtaccacctgcgcgtgggtctttgctggagccgacaaagactgggatatcgctgcgtactgcgggtagcaacgttgccggatgcagtacttttgcaccaaaagttgccatctctgccgcttcggcaaacgcgatttcatcaatgcgttttgctgcggaaaccacgcgtggatcggtggtgtagatgcccgggacgtcggtccagatatcaacacgagatgcgtgtaaagcctccgccagcaaggctgccgtataatcgctgcctccacggccaagcgtcgttgtacgacctttattttcgctgccgataaatccctgggtgatcactaagccttcattgaggcgtgggagcagctgcagcgcggccagttccgccagcgcggctacatctggctctgcacgaccaaatcgatcgttggtacgcatcactttacgtacatcaaaccactgtgcctgaacatcgcgttcgcgcaggatctcgacaaacagcagggtcgacatcagctcgccgtggctgaccagttcatctgtcagggccggagacgttgccagcgccgccgcttctgccagaacagtaatattctccagcagacgttcaatctcttcacggataacgttcgggtaatgcagacgttccagaatggcaaactggatattgcggattgcgtcgagtttttcaaatcgctcgccaggttccagtccttcagctaaagcgaccagtagattagtgataccagcagaagccgagaggacaactaaacgtacgttggcatcagaaagcacaatatcagcgctgcggttcatggcgtcaaaatcagctacgctggtaccgccaaatttggagacaacaatttcagacataactacctcgtgtcaggggatccattttcagccttggcacaagggaagagcggaagacgggtgggcgcagagcgatacttcgctactattttcacccagaagtgctccaccacttgcgaaacgcccgactgcgaacgcttctggtgacaacccaggggattcagcccctgtagccgatgatgaacgtagccagccgttcaatcacctcggcgatgcaccccctcaggtgttatcacaggactggctcctccaacaccgttacttgggcaacgcgcctcttctggcctgcgctagcgcaggtagtacatttataaataaagggtgagcggggcggttgtcaacgatggggtcatgcggatttttcatccactcctggcggtcagtagttcagctaataaatgcttcgctgcgctaagggtttacactcaacattacgctaacggcactaaaaccatcacatttttctgtgactggcgctacaatcttccaaagtcacaattctcaaaatcagaagagtattgctaatgaaaaacatcaatccaacgcagaccgctgcctggcaggcactacagaaacacttcgatgaaatgaaagacgttacgatcgccgatctttttgctaaagacggcgatcgtttttctaagttctccgcaaccttcgacgatcagatgctggtggattactccaaaaaccgcatcactgaagagacgctggcgaaattacaagatctggcgaaagagtgcgatctggcgggcgcgattaagtcgatgttctctggcgagaagatcaaccgcactgaaaaccgcgccgtactgcacgtagcgctgcgtaaccgtagcaataccccgattctggttgatggcaaagatgttatgccggaagtcaacgcggtgctggagaagatgaaaaccttctcggaagcgattatttccggtgagtggaaaggctataccggcaaagcaatcactgacgtagtgaacatcgggatcggcggttctgacctcggcccgtacatggtgactgaagcactgcgtccatacaaaaaccacctgaacatgcactttgtttctaacgtcgatgggactcacatcgcggaagtgctgaaaaaagtaaacccggaaaccacgctgttcctggtagcatctaaaaccttcaccactcaggaaaccatgaccaacgcccacagcgcgcgtgactggttcctgaaagcggcaggtgatgagaagcacgttgcgaaacactttgcggcgctctcaaccaacgccaaagccgttggcgagtttggtattgatactgccaacatgttcgagttctgggactgggtcggcggtcgttactctttgtggtcagcgattggcctgtcgattgttctctccatcggctttgataacttcgttgaactgctttctggcgcacacgcgatggacaagcatttctccaccacgcctgccgagaaaaacctgcctgtactgctggcgctgattggcatctggtacaacaatttctttggcgcggaaactgaagcgattctgccgtatgaccagtatatgcaccgtttcgcggcgtacttccagcagggcaatatggaatccaacggtaagtatgttgaccgtaacggtaaggttgtggattaccagactggcccgattatctggggtgaacctggcacgaacggtcagcacgcgttctatcagctgatccaccagggaaccaaaatggtaccgtgcgatttcatcgctccggctatcacccataacccgctctctgatcatcaccagaaactgctgtctaacttctttgctcagaccgaagcgctggcgtttggtaaatcccgcgaagtggttgagcaggaatatcgtgatcagggtaaagatccggcaacgcttgactacgtggtgccgttcaaagtgttcgaaggtaaccgcccgaccaactccatcctgctgcgtgaaatcactccgttcagcctgggtgcgttgattgcgctgtatgagcacaaaatctttactcagggcgtgatcctgaacatcttcaccttcgaccagtggggcgtggaactgggtaaacagctggcgaaccgtattctgccagagctgaaagatgacaaagaaatcagcagccacgatagctcgaccaatggtctgattaaccgctataaagcgtggcgcggttaatcattgtcgatatgtaggccggataaggagttcacgccgcatccggcaaccgatgcctgatgcgacgcggtcgcgtcttatcaggcctacaggtcgatgccgatatgtacatcgtattcggcaattaatacatagtacgattgattaaatagccttaaaaacaatgccgacgttatgtcggcattttttatcagataaatccccttgtctgtgatttaacggaaatcataccgtgaggttaatcctaaaatagatttttaatcgtgattgatttcggaaaatacgcagattaattacttttatttttattttaagcttatgatttttagtgctatttatatataagctgaagcttatatttgatattcattccaattatcctaaaaccccatcactaattccccgcgccgtaattcgcatgctttagttgtgtatactcgatcccgcccgaaatgtttttgggtaaatctccattcattcaatgaagggaaattgttatgaaaaaagttctgtatggcatttttgccatatctgcgcttgcggcgacttctgcgtgggctgcacctgtacaggtgggcgaagcggcaggatcggcagcaacgtcggtttcggcggggagttcctccgcgaccagcgtcagcaccgtaagctcggcggtgggtgtcgcgctcgcggcaaccggtggcggtgatggttctaataccgggaccaccacaaccacgaccaccagtacccagtaataaagtatgtatccccaaaataattcgagttgcaggaaggcgacaagcgagtgagtccccgggagcatagataactatgtgaccggggtgaacgagtgcggtcaccgcatctgcagcttgaagtatgaaggggattaaccataaccacactccggtgtggttattctgcccctctggagaagagtcgtgaagcgacctgcactcattcttatctgcctgctattacaggcctgttcagccacgactaaagagctgggcaattcactatgggacagtctgttcggtacgccaggcgtacagctgacggacgatgatattcaaaatatgccctacgccagccagtacatgcagcttaatggcgggccgcagttatttgtggtgctggccttcgctgaagacggacaacaaaaatgggtcactcaggatcaggccacccttgtcacacaacatggtcgtctggtgaagactttgcttggcggcgacaacctgattgaagtgaataaccttgccgccgacccgctgattaaacccgcacaaatcattgatggtgcaacctggacgcgcacgatgggctggaccgagtaccagcaggtacgctacgccaccgcgcgctcagtcttcaaatggaatggcaccgataccgtcaaagtcggcagcgatgaaaccccggttcgcgtgctggacgaagaagtcttcactgaccaggcgcgctggcataaccgctattggatcgacagcgaagggcaaattcgccagtcggaacagtatctcggcgcggattacttcccggtgaaaaccaccctcatcaaggcggcaaaacaatgattaaacaaactattgtcgcgttgcttttgagtgcgggggcgtcatcagtcttcgcggcgggaaccgtcaaggtgttcagcaatggcagcagtgaggccaaaacgctgacgggcgcagagcatttaatcgatctggtaggccaaccgcggctggcaaacagctggtggcccggagcggtgattagcgaagagctggccacggcggctgcattgcgtcagcagcaggcgttgctgacacggctggcagaactggctgcagattccagcgccgacgatgccgccgcgattaacgccttacgccagcaaattcaggcgttgaaggtgacgggcaggcaaaaaatcaatcttgatcctgatatcgtccgcgttgccgaacgcggtaacccgccgttgcagggcaactacacgctgtgggtcggaacgccgccgtccacggtcacgttgttcgggcttatcagtcgtcctggcaagcagtcattcactccaggtcgcgacgtggcgagctatctctctgaccagagcctgctcagcggtgcggatcgcagctacgcgtgggtggtttacccggacggacgcacgcaaaaagcgccggtggcttattggaacaagcgtcacgtagagccgatgcccggcagcattatttatgttggcctcgcggactccgtctggagtgagacacctgatgcccttaacgccgacattcttcagactctgacgcagcggataccccaataatgaaaaaaagacatctgcttagcttactggcgctgggcattagcacagcttgctacggcgaaacatatcctgcgcccattggtccgtcgcaatcggatttcggtggcgtaggattattacaaacgcccaccgcgcgcatggcgcgggaaggggagctgagcctgaactatcgcgataacgatcagtaccgttattactcagcttcagtgcaactcttcccgtggctggaaacaacgctgcgctacaccgacgtgcgcacccggcagtacagcagcgtcgaagcgttctctggcgatcaaacgtataaagataaagccttcgatctcaaactgcgtttgtgggaagagagttattggctgccgcaagtggcggttggtgcgcgggatatcggcggtacggggctgtttgatgcggaatatcttgttgccagcaaagcctgggggccgttcgattttacgctcggcctgggatggggatatctgggcaccagcggtaatgtgaaaaatccgctctgttcagccagtgataaatattgctatcgcgataacagctacaaacaagcgggatctatcgacggcagtcagatgttccacggcccggcctcactgtttggcggcgtggaataccagacgccctggcaaccgctgcgcctgaaactggagtatgaaggtaataattatcagcaggattttgccgggaagctggagcaaaaaagtaagtttaacgtcggggcgatttatcgcgttaccgattgggccgacgttaaccttagctatgaacgtggcaacacctttatgtttggcgtcacgctgcgcaccaactttaacgatctgcgcccgtcctacaacgataacgcccgaccgaaataccagccgcaaccgcaggatgccattttgcagcactcggtggtggcgaatcagttaacgctgttgaaatacaacgccggactggccgatccgcagatccaggcgaaaggcgatacgctgtatgttaccggcgagcaggtgaaatatcgtgattcgcgcgaagggatcatccgtgctaatcggatcgtgatgaacgatctgccggatgggatcaaaacgatccgcattacggaaaatcgccttaacatgccgcaggtgacgacggaaaccgatgtcgccagcctgaaaaatcatctcggcggagagccgttgggccacgaaacgacgctggcgcaaaaacgcgtcgagccagtggttccgaagtccaccgagcagggctggtatatcgacaaatcacgctttgatttccatatcgatccggtgctgaaccagtcggtcggtggcccggaaaacttttacatgtatcagctgggcgtgatgggaacggcggatttgtggctgacggaccatctgctgaccaccggcagcctgtttgctaaccttgccaacaactacgacaagtttaactacaccaatccaccgcaggactcgcacttaccgcgcgtgcgtacccatgtgcgcgagtatgtgcagaatgatgtctatgtgaataacctgcaagccaactacttccagcatctgggcaacggcttctacggtcaggtctacggaggttatctcgaaaccatgtttggcggcgtgggggcagaagtgttgtatcgcccgctggatagcaactgggcgtttggtctggatgccaactacgttaaacagcgcgactggcgtagcgcaaaagatatgatgaaattcaccgattacagcgtgaaaaccggacatctgaccgcgtactggacgccatctttcgcccaggacgtgttagtgaaagcgagcgtcgggcagtatctggctggggataaaggcggcacgctggagatcgctaaacgctttgacagcggcgtggtggttggcggctatgccacgatcaccaacgtttcgaaagaggagtacggcgaaggggacttcaccaaaggcgtgtatgtctctgtaccgttggatctcttctcgtctggcccgacacgcagccgtgcggcgattggctggacgccgctgacgcgtgacggtggtcagcaacttgggcgtaagttccagttgtatgatatgaccagcgaccgtagcgtcaatttccgctaagtcatgggaaaggtgccagttttcgcactcactggcaccttcattcttaatggcctgtcgagccatcaggaacgcagttcacccccggtttgcgatctggtgtgtaaaggcgaaaacattctgtcttcctgtccgtcgatatcggttgcaggtctggttgcctgagcgactgggccatcattggactggagacattgctttgcggtaggtcggctttatcagcagtaccgagcggaccagcataagcaggaagaacagagactgataacatcaaagcagcaaaataaggcttcatttttaccacctttatcaggttacgtttcatttgttccagaggaacattgtcgatttttcgcgcattgctggtggctgggaatcacctgaatgggtgatttttttgggctgtgtgttttgccagatgcgacgttgatgggagatgcccacttaattgagctgaacaaaacatacacaaaaaatatagatctccgtcacatttttgcgttatacaggaagctcgccactgtgaaggaggtactgctatgacgtcactctctcgtccgcgcgtggagtttatctccaccattttgcagaccgtactcaatcttggcctgttgtgcctcggcctgattttggttgtcttcctcggcaaagaaacggtgcatctggctgatgtgctgttcgcgccagaacaaaccagtaaatatgagctggtagaagggctggtggtttattttctctatttcgaatttatcgcgctgattgtgaagtactttcagtccggttttcacttcccgctacgttactttgtctatattgggatcaccgccattgtgcgcttgatcatcgtcgatcataaatcgccactggatgtgttgatctactcggcagcgatcctgttactggtgatcaccctgtggttgtgtaattcgaaacggctgaagcgggagtaaaaaaaggcgctccgtggagcgccgaataacagtcacaagttgggataaagtaagttgagggtgcagcggcataacattggcagaacaacatctttaacctttcacaccacctgccgtcaggccgttgaccagccagcgttgagccagcaagaagacgatggtgatcggtaatgcagacatcacggcagcggcggcaaagtcaccccacaggtagttttgcgggttgaggtattgctgcatccccacggccagggtgtagctgtttacgtcacgcagtaatagcgacgcgaccggaacttcagtaatggcagcgataaacgacaggatgaacacaaccgccagaatcggtactgacagcggcaacaggacaaggcggaaggcctgccacggtgtcgcaccatccagcgccgccgcttcttccagcgaactgtcgatggtttcgaaataacctttgatggtccagacatgcagcgcaatcccgcccagatacgcgaaaattacgccgccgtgagtattcaggccaatgaatggaatgtactcacccagacgatcaaacaacgcatacaacgcgaccagtgaaagtactgccgggaacatctggaaaatcagcattcctttcagcagcgtcgctttgcctggaaagcgcatacgggcgaaagcgtaggcgcaggtggtggagagcgccacaatgccaatcgcggaaatcccggcgacctttaccgagttccacagccacagcagtaccgggaatggcggtggcgtaatgcgaccatcagcctgttccacactaaaacctaacgccagtttccagtgattccaggagatttgctccgggatcagactaccggtcgcgaagttcccctgacgcagcgagatggcgacgaccatcagcagcgggaacataattgccgcgataaaaagtagcagtagcaggtgagtaataaacaaacgtgctttttgcgatttcggttggaccattgccatttttgttatctcccttaatcaaacttcattcgcgtggctttcaggttcactatcgccagcgcgcccaccagcaggaagatcagcgtggcaattgctgctgccagaccgaagtcctgacccccgccgccttcaaaagcgatacggtaggtgtagttaacaagcaggtcggtataaccggctggcgtggtcgtgccaagacgatccgggccgccgttggttaacagttgaatcagcacgaagttgttaaagttaaaggcgaagctggcgatcatcagcggcgtcagcggtttaatcagcagcggcagcgtaatcttaaagaagttctggaatggacctgcgccatccattgctgaggcttcatacaaatcgtccggaatcgccttcagcaagcccatgcagaggatcatcatgtacggataacccagccaggtgttgacgataatcagcatcgtgcgggcggtggtcggatcgctgaaccaggcgggcttcacgccaaacagcgcgctcaacatcatgttgatttcaccaaaactctggttaaacaaccctttgaaaatcaagattgaaatgaacgatggcaccgcgtagggcagaataagcaggacgcgatagaccgctttgccgcgcaacgcttcccactgcaccagacacgccagaaccatgccgaccgccaccgttaaaaagacagtgatcagcgagaacaccacggtccagacgaaaatggcgaggaacggtttctgaatgccttcgtcggtaaagacgcgggtaaagtttttccagccggtggtcacggtgtaaccggggcttagcttttcatccccccagttgccatcggcggtaatggactggtaaaagccaatttggttattcggacgatatttcacgccgctctgattattggtcaacgtgccgtcaccgtcgagtgtgtagagcggttgcgtgccagaaaactggcgcagggagctcatcatcactttgttgccattcggcagaatggcggtaatgtcactcagtgcctgacgattctgggtaatcacgcgcagattcgcgcgctcgccttcaggctgcgtggcgctttctttcaattgcagtttttgctcgccgccaaatttgaaagcgtcggagaggtaatttttgccggtttcgccgtcgctgagcgccagttgccactcatcgcccgccggataaagaccaaaattatagattttgcctgcttgccaggagcgatctagcaacacttcctgcgcacgttcaaaagtcagctggttagtgctgctgtagttggtgaaggcaatggcgatggtgcagaccagagggaagaggacgaataatcccattccagccattcccgggtaaacatagcgccaggcgtaggctttacgattggcgaaaatatacagccccgctgagctcaatatcagcgtggtaatggcgaacaggtattccccttgtgcgtacattaaaacaacaaggtaacccaccagcaggccgagcagacctaacactgaccatttcagcgcgtcgctttgccaccaatgtttctttttaatgacatccatggggttcttcctcattccaggacggataaggctttcataccttatccgacaacaactgcctgatgcgacgctgacgcgtcttatcaggcctacatacgtttcaatttcgtaggccggataaggcgtttacgccgcatccggcatttcacagcattacttggtgatacgagtctgtgcatctttcagcgcagcatccacagtctgacgaccgctggcggcgttgatcaccgcagtacgcacggcataccagaaagcggacatctgcgggatgttcggcataatttcacctttctgagcgttatccatggtggcggcaatacgtggatctttcgcaagttcatcctgataggacttcagcgctactgcacccagcggtttgtctttattgaccgcttccagaccttcgtcagtcagcagatagttttcgaggaactctttcgccagctctttgttcggactggcggcgttaatacctgcgctcagcacgccaacgaacggtttagatggttgacctttgaaggttggcagtaccgttacaccataattcactttactggtgtcgatgttggaccatgcccacgggccgttgatagtcatcgctgtttcgcctttattaaaggcagcttctgcgatggagtaatcggtgtctgcattcatgtgtttgtttttaatcagatcaaccaggaaggtcagacccgctttcgcgccagcgttatccacgcctacgtctttaatgtcgtacttgccgttttcatacttgaacgcataacccccgtcagccgcaattagcggccaggtgaagtatggttcttgcaggttgaacatcagcgcgctcttacctttcgctttcagttctttatccagcgccgggatctcttcccaggtttttggcgggttcggtagcagatctttgttataaatcagtgataacgcttcgacagcgatcgggtaagcaatcagcttgccgttgtaacgtacggcatcccaggtaaacggatacagcttgtcctggaacgctttgtccggggtgatttcagccaacaggccagattgagcgtaaccaccaaagcggtcgtgcgcccagaagataatgtcagggccatcgccagttgccgcaacctgagggaatttctcttccagtttatccggatgctcaacggtgactttaattccggtatctttctcgaatttcttaccgacttcagcgagaccgttatagcctttatcgccgttaatccagattaccagtttaccttcttcgattttggcgagagccgaggcggaaaacatcatcgtcgttaatgcggataatgcgaggatgcgtgcacctgtttttattttcataatctatggtccttgttggtgaagtgctcgtgaaaacacctaaacggactctagtttctttatacggcaacctctttccatcctccttgcccctacgccccatcgttgctttgtgtgatctctgttacagaattggcggtaatgtggagatgcgcacataaaatcgccatgatttttgcaagcaacatcacgaaattccttacatgacctcggtttagttcacagaagccgcgttctcatcctcccgcctcctcccccataaaaaagccagggggtggaggatttaagccatctcctgatgacgcatagtcagcccatcatgaatgttgctgtcgatgacaggttgttacaaagggagaagggcatggcgagcgtacagctgcaaaatgtaacgaaagcctggggcgaggtcgtggtatcgaaagatatcaatctcgatatccatgaaggtgaattcgtggtgtttgtcggaccgtctggctgcggtaaatcgactttactgcgcatgattgccgggcttgagacgatcaccagcggcgacctgttcatcggtgagaaacggatgaatgacactccgcctgcagaacgcggcgttggtatggtgtttcagtcttacgcgctctatccccacctgtcagtagcagaaaacatgtcatttggcctgaaactggctggcgcgaaaaaagaagtgattaaccagcgagttaaccaggttgcggaagtgctgcaactggcgcatttgctggatcgcaaaccgaaagcgctctccggtggtcagcgtcagcgtgtggcgattggccgtacgctggtggccgagccaagcgtatttttgctcgatgaaccgctctccaacctcgatgctgcactgcgtgtgcaaatgcgtatcgaaatctcccgtctgcataaacgcctgggccgcacaatgatttacgtcacccacgatcaggtcgaagcgatgacgctggccgacaaaatcgtggtgctggacgctggtcgcgtggcgcaggttgggaaaccgctggagctgtatcactatccggcagaccgttttgtcgccggatttatcggttcgccaaagatgaacttcctgccagtaaaagtgacctccaccgcaatcgatcaagtgcaggtggagctgccgatgccaaatcgtcagcaagtctggctacctgttgaaagccgtgatgtccaggtgggagccaatatgtcgctgggtattcgtccggaacatctactgccgagtgatatcgctgacgtcatccttgagggtgaagttcaggtcgtcgagcaactcggcaacgaaacccaaatccatatccagatcccttccattcgtcaaaacctggtgtaccgccagaacgacgtggtgttggtagaagaaggtgccacattcgctatcggcctgccgccagagcgttgccatctgttccgtgaggatggcactgcatgtcgtcgactgcataaggagccgggcgtttaagcaccccacaaaacacacaaagcctgtcacaggtgatgtgaaaaaagaaaagcaatgactcaggagatagaatgatgattactctgcgcaaacttcctctggcggttgccgtcgcagcgggcgtaatgtctgctcaggcaatggctgttgatttccacggctatgcacgttccggtattggctggacaggtagcggcggcgaacaacagtgtttccagactaccggtgctcaaagtaaataccgtcttggcaacgaatgtgaaacttatgctgaattaaaattgggtcaggaagtgtggaaagagggcgataagagcttctatttcgacactaacgtggcctattccgtcgcgcaacagaatgactgggaagctaccgatccggccttccgtgaagcaaacgtgcagggtaaaaacctgatcgaatggctgccaggctccaccatctgggcaggtaagcgcttctaccaacgtcatgacgttcatatgatcgacttctactactgggatatttctggtcctggtgccggtctggaaaacatcgatgttggcttcggtaaactctctctggcagcaacccgctcctctgaagcgggtggttcttcctctttcgccagcaacaatatttatgactataccaacgaaaccgcgaacgacgttttcgatgtgcgtttagcgcagatggaaatcaacccgggcggcacattagaactgggtgtcgactacggtcgtgccaacctgcgtgataactatcgtctggttgatggcgcatcgaaagacggctggttattcactgctgaacatactcagagtgtcctgaagggttttaacaagtttgttgttcagtacgctactgactcgatgacctcgcagggtaaaggtctgtcgcagggttctggcgtcgcgtttgataacgaaaaatttgcctacaatatcaacaacaacggtcacatgctgcgtatcctcgaccacggtgcgatctccatgggcgacaactgggacatgatgtacgtgggtatgtaccaggatatcaactgggataacgacaacggcaccaagtggtggaccgtcggtattcgcccgatgtacaagtggacgccaatcatgagcaccgtgatggaaatcggctacgacaacgtcgaatcccagcgcaccggcgacaagaacaatcagtacaaaattacccttgcacaacaatggcaggctggcgacagcatctggtcacgcccggctattcgtgtcttcgcaacctacgccaagtgggatgagaaatggggttatgactacaccggtagctcttcaaccaacccatactacggcaaggctgtgtcggctgatttcaacggcggtagcttcggtcgtggcgacagcgacgagtggaccttcggtgcccagatggaaatctggtggtaatagcaaaacctgggccggataaggtgcttgcgtcgcatccggcaaccaatgcctgatgcgacgctgttgcgtcttatcaggcctacaactgctgccgaaagtaggccggataaggcgtttacgccgcatccggcataaaaacagctttaaggggcgaaagcccctctgattatcgggtttagcgcgctattgcctggctaccgctgagctccagattttgaggtgaaaacaatgaaaatgaataaaagtctcatcgctctctgtttatcagcagggttgctggcaagcgcacctggaatcagccttgccgatgttaactacgtaccgcaaaacaccagcgacgcgccagccattccatctgccgcgctgcaacaactcacctggacaccggtcgatcaatctaaaacccagactactcaactgtcgaccggcggccaacaactgaatgtccctggcatcagtggtccggttgctgcgtacagcgtcccggcaaacattggtgaactgacactgacgctgaccagcgaagtgaacaaacaaaccagcgtatttgcgccgaatgtgctgattcttgatcagaacatgaccccatcagccttcttccccagcagttatttcacctaccaggaacccggcgtgatgagtgcagatcggctggaaggcgttatgcgcctgacaccggcgttggggcagcaaaaactttatgttctggtctttaccacggaaaaagatctccagcagacgactcaactgctcgacccggctaaagcctatgccaaaggcgtcggtaactcgatcccggatattcccgatccggttgctcgtcataccaccgatggcttactgaaactgaaagtgaaaacgaactccagctccagcgtgttggtaggaccactatttggttcttccgctccagctccggttacggtaggcaacacggcggcaccagctgtggctgcacccgctccggcaccggtgaagaaaagcgagccgatgctcaacgacacggaaagttattttaataccgcgatcaaaaacgctgtcgcgaaaggtgatgttgataaggcgttaaaactgcttgatgaagctgaacgcctggggtcgacatctgcccgttccacctttatcagcagtgtaaaaggcaaggggtaattacgccccacagtgctgattttgcaacaactggtgcgtctcctagcgcacctttttttctcctcctgtactattgttgcgtttttgttgcgcattagttcacttaatttgctttacatctcccgtaaatatttttctgcgatacaatgcctttacgttatgtaacggagagttcggcatgtcacaccccgcgttaacgcaactgcgtgcgctgcgctattttacagagatccctgccctggagccgcaactgctcgactggctgttgctggaagattccatgacaaaacgttttgaacagcagggaaaaacggtgagcgtgacgatgatccgcgaagggtttgtcgagcagaatgaaatccccgaagaactgccactgctgccgaaagagtctcgttactggttacgtgaaattttgttatgtgccgatggtgaaccgtggcttgccggtcgtaccgtcgttcctgtgtcaacgttaagcgggccggagctggcgttacaaaaattaggtaaaacgccgttaggacgctatctgttcacatcatcgacattaacccgggactttattgagataggccgtgatgccggactgtgggggcgacgttcccgcctgcgattaagcggtaaaccgctgttgctaacagaactgtttttaccggcgtcaccgttgtactaagaggaaaaaaatatggagtggagtctgacgcagaataagctgctggcgtttcatcgcttaatgcgtacggataagccaattggcgcgttactgctgctctggccaacattatgggcgttgtgggtggcgacaccgggcgttccccagctctggatcctggcggtgtttgtcgcgggcgtctggctgatgcgcgctgctggttgcgtggtgaatgattatgctgaccgcaagtttgatggtcatgttaagcgcacggcgaaccgaccacttcccagcggcgcggtaacggagaaagaggcgcgcgcgctgtttgtagtgctggtactgatttcatttttactggtgctgacgctgaatacgatgactattctgttgtcgattgccgcgctggcgctggcgtgggtatacccgtttatgaagcggtatacccatctaccgcaagtggtgctgggcgcggcgtttggctggtcgattccaatggcttttgccgctgtgagtgagtcggtgccattgagttgctggttaatgttcctcgccaatattctctgggcggtggcttacgacacgcagtatgcgatggttgaccgcgatgatgatgtgaagattggcattaaatccaccgcaatcctgttcggccaatacgataaattgattattggtattttgcagattggcgtactagcgctgatggcgatcatcggtgagttaaatggcttaggctggggatattactggtcaattctggtagctggcgcgctgtttgtttatcaacaaaaactgattgccaaccgcgagcgtgaagcctgctttaaagcatttatgaataataactatgttggtctggtactgtttttagggctggcaatgagttactggcatttctgatgatgtaaaaaagccggatgatcatccggctttcttctgggttgcctgatgcgctgcgcttctcaggcctacacaacatatcgcaatttattgaatttgcagatcatggtaggccgaataaggcgtttgcgtcgcatccggcaattctcactgattacccttcgccctgcgtcgcactctcaatcgtcaaacgcacgtctgatgtaatcaactccgccagcaactgatacaccttcatcgtttctgccggttcggcgtcgccgctatcgctgatatacccttcatcacgcagtgtcagcaccagagaactgaacaccgccttgtcgaagaactccggcgcgttgataccgtgcagcacggagagacgttgcgcgacggtgcggctctctttctccagcgtaccgcggttgatcgacgggttggcactcaacagccagaaggtgatggcataacgttgcagcgtttcgcgcgcgcctgcggccagcagctgtagcgtgcgagaatgcgccgggttgatatgcaactcatcatcttgcagggtaatcagcccctgacgttgcatctcatttgccagcgcatcaataacgtccggtaactcgtcgcgatcccagcgcaggaacagctccgctttcagcattgggtaaagcacattgacgtgctccatcaatacgtcgcgggagatgtggcgatgctgggtgacaattgccgccatcagcgaaggcagcaccaacatatgtgcaatgttgttgcgatagtaggtcatcagcaccgcttgctcgcgcggcagaatgatgatgtcgccgatagtgtctttctcaacttcaaacttgttcatttgcagcgcgtgatcgataagctcgctggcgctggctgaaggaacggtagagtccgtggagtaaggtacgttgcgcatcagatccaggtagcagttgagttgctcggttaactgctcgcgggtgagtgagcgctgacgtgacgccagaagcgcagtacagcacaggttcatggcgtttgccgcgcctgcgttgttaatgcgtaccatcagatcggcagcaatattattgaccgtcggcgttaaccaggccggacgcaccgcttcgatgggatcgatagattcacgccagtctggtacgtgctggttaaggtaggtcatcaacggcattggttcaccgaagttgacgtaaccctgaccgagattacgcagcttgcttaaaccacgcagcatctgcggcaggctctctttctctttcgtcgcaccgcgcagttctttggcgtaagtacccacttccatgacgtgctcataaccgatatagatcggaatcagcgtaatcggacgagtgccgccacgcagcatcgcctgaatggtcatcgacagtgtaccggttttcggatccagcaaacgccccgtacgggaacgaccgccttccacgaaatactcgacggaataaccacggctgaacagttcgccgagatactcacggaaaacggtggaataaagtttattgcctttaaacgtacggcgaataaagaacgcccccagacggcggaaaatcggcccggccggccagaagttcaggttgatcccggcggcgatatgcggcggcaccagcccctggtgatacagcacgtaagaaagcagcaggtagtccatgtgactgcggtggcaaggcacatacactagctcatggccgtcgtgggccagctggcgaacgcgctcggcgttatggacgttgataccctggtaaagtcggttccaggtgaagcccagaatgcggtcagtcaggcggatcatctcgtaagagaaattcgccgcaatctcttccatcagcgcaatcgcgttctgctgcgctttttcatgggagatttttttgctgcgtgcttcatcttctaccgctttcgcaatggcgcgggaggcgagcagcttattaaacagatcctgacgagcaggcagacgcggacccacggcagccagacgttgacgggcaaagtgcatacgtgctacgcgcgccagtttctgagcgatagttttatccgtgccgtgttcatccgccatacggcgcagcgaaactgacggcgagaaacgcacaaaactgtcgcgaccgagccacagtacagcgaaaaatttctgtacgccgttaagcatacgcagcggcgggttcacttcgcctttttcacgccccggcgcgcgaccaaacatcaccgatactggcaccatctgcacatccagatttgggttgctgcggtgcaaatcgagatagtcgtggaacagcttaatagactcttctttcggcgtgtaataggtgaacacacgcggcccgccgtgaatgaacacatagcgcggcagtagcgtgccgtcgatttccagcggctctaacgggtcaggcaggtcatgtgccagacactgggcgcgcaacgtcagcaagtcagctttcgagttgtacggtaaaacgtacataattggacgagaggtatccagccccagttccggggcaggatccgccggaatagacttgctttttaccaggatgcttaatggtaaattcagtaatttgtagtaaattcgtggccagccggacataaacgatgtaaagcctctggttaataatgcaaatgcgcggcaaggatagcagaaagtcatgggaaattctgtggtatccgctcatgtttcgcgcggcgttacgcaaacccgaatcatcggatttaacggtacactgatattgacgctcataatgtaaaaaggttctttcaatggccaataataccactggattcatccgaattattaaagctgctggctattcctggaaaggtttacgcgctgcatggatcaacgaagcggcattccgtcaggaaggcgtagcggtattgttagcggtggttatcgcctgctggctggatgtggacgcgattacccgcgtgctgcttatcagctccgtgatgctggtgatgattgtggaaattctcaatagcgccatcgaagctgtggttgaccgaattggctctgaataccatgagctttccggacgcgctaaagatatgggatccgccgcagtgctgattgccattatcgtcgccgtgattacctggtgcatcctgttatggtcgcattttggataacccttccagatttcgataaatctctggtttattgtgcagtttatggttccaaaatcgccttttgctgtatatactcacagcataactgtatatacacccagggggcggaatgaaagcgttaacggccaggcaacaagaggtgtttgatctcatccgtgatcacatcagccagacaggtatgccgccgacgcgtgcggaaatcgcgcagcgtttggggttccgttccccaaatgcggctgaagaacatctgaaggcgctggcacgcaaaggcgttattgaaattgtttccggcgcatcacgcgggattcgtttattgcaggaagaggaagaagggttgccgctggtaggtcgtgtggctgccggtgaaccgcttctggcgcaacagcatattgaaggtcattatcaggtcgatccttccttgttcaagccgaatgctgatttcctgctgcgcgtcagcgggatgtcgatgaaagatatcggcattatggatggcgatttgctggcagtgcataaaactcaggatgtacgtaacggtcaggtcgttgtcgcacgtattgatgacgaagttaccgttaaacggctgaaaaaacagggcaataaagtcgaactgttgccagaaaacagcgagtttaaaccaattgtcgttgaccttcgtcagcagagcttcaccattgaagggctggcggttggggttattcgcaacggcgactggctgtaacatatctctgagaccgcgatgccgcctggcgtcgcggtttgtttttcatctctcttcatcaggcttgtctgcatggcattcctcacttcatctgataaagcactctggcatctcgccttacccatgattttctccaatatcaccgttccgttgctgggactggtcgatacggcggtaattggtcatcttgatagtccggtttatttaggcggcgtggcggttggtgcaacggcgaccagctttctctttatgttgttgctgtttttacgcatgagcaccaccgggctgactgcacaggcttatggtgccaaaaatcctcaggcattagcccgtgcgctggtgcaaccgttgctgttggcgttgggggccggggcgttaattgcgctgctgcgtacgccgattatcgatctggcgctgcatattgttggtggtagtgaagcagtcctggaacaggcgcgacgctttcttgaaatccgctggttaagcgcaccggcgtcgctggcgaatctggtattacttggttggttactcggcgtgcaatatgcccgtgcgccagtaattttgttagtggtcggcaatatcctcaacattgtgctggatgtctggctggtgatggggctgcatatgaacgtgcagggcgcggctctggcaacggttattgcggaatatgcaacattgctgattggtctgctaatggtgcgtaaaatcctcaaactacgcggaatctccggcgaaatgctgaaaacagcctggcgaggaaacttccgtcacttgctggcgcttaaccgcgatatcatgctgcgctcgctgttgctgcaactctgtttcggcgcgatcactgtacttggcgcgcgactggggagtgacattatcgctgttaacgcggttctgatgacgctactcacctttaccgcctatgcgttggatggttttgcctacgcggttgaagcacattccggtcaggcatacggtgcgcgcgacggtagtcaattgctggatgtctggcgggcagcgtgccgccagtcggggatcgtagcgttactgttttcggtggtttatttgctggcaggggaacacatcattgcgttgctgacgtcgttaacccagattcagcagctggctgaccgctatcttatctggcaggtgattttgccgttggtcggcgtctggtgttatctgctggacggcatgtttataggcgcaacgcgtgccgccgaaatgcgtaacagtatggctgtggccgccgcaggttttgcgctgacgctccttacgctgccgtggctggggaatcatggtttgtggctggcgttaaccgtctttctggcgttacgcgggctttctctggcggctatctggcggcgtcactggcgtaacgatacctggtttgtcgcaacgtgacggttaaaaattctgaataaataatcctaagccaaattgctgactacacttaatctcacgttcagaagaaaagtgaacgtactctcattcacaacctaacgatgaggtcttgattatgaataaagatgaagccggcggtaactggaaacagtttaaaggtaaagtgaaagagcaatggggcaaactgaccgatgatgatatgacgatcattgaaggaaaacgtgatcagttagtgggtaaaatccaggaacgctacggttatcagaaagatcaggcagaaaaagaggttgatagttgggaaaaacgccatgattaccgctggtaattaatccctcctgcccgacatgtacaaggatgtacacccttttagcgaggtttctttttcacctgaatagagtggtcatgatggcactgttcgggatgacgacacgcttcgacttctacacatgctgaacataatccatgtgcttcaataacattatgccgcagggcaaaacccatttttgccgccagcgtatgcatgatgtcttccacgccttcagcacattcttctttcaccgcgccgcagcgatcgcaaataaacatggctgaagtatgggtgggctgatcgaacagatgacagagcacataactgttggtggattccaccttatgcacaaaaccttgttcaagcagaaactccagcgcgcgataaaccgttggcggcttggcttgcggttcagcttcgcgcagcaaatcaagcagatcataagcgctgatagcgccatcctgcagactcatcaggcgcaacacttcgagacgctgtggggtcaggcgcacattacgctgtgcgcagattttttcagcctgcgctaataactcctgcgttgtggtcttttccattgggcacctcgacagtggggttaagaatgtccttactttaccatagttctcacttaaacgccgagaacagggtgtcatggctgtcacattgcctgatcgcatattcgttatgctatagtagcgcccccaatttaccagatgcttaaaaagtcgccatgccagcagaatcacacactgtttatcccgcttaccgtttctcgattgccccgatgcttgactggacggacagacattgccgttatttcctgcgtctgctttcccgcaatacgttgctgtataccgaaatggtgaccacaggggcgattattcacggtaaaggtgattacctggcgtacagtgaagaagaacatccggtagcgttgcaactcgggggtagcgatccggcggcgctggcacagtgtgcgaagctggcagaagcgcgcggatatgatgagatcaacctgaatgtcggctgcccgtctgaccgggtgcagaacggcatgtttggtgcgtgtctgatgggtaatgcgcagctggttgccgactgcgtgaaagcgatgcgcgatgtggtgtcgattccggtgacggtgaaaacgcgtattggcatcgatgatcaggacagctatgaatttctctgtgatttcatcaacaccgtttccggcaaaggtgagtgtgagatgttcatcatccacgcacgtaaagcctggctttctgggttaagtccgaaagaaaaccgtgagatcccgccgctcgattatccgcgtgtgtatcaactgaagcgtgactttccgcatctgacgatgtcgattaacggtggtatcaagtcgctggaagaagctaaagcgcatttgcaacatatggatggcgtgatggtcgggcgcgaggcgtatcagaatccgggtattctggcggcggtagaccgagagatttttggttcctcggatactgatgctgatccggtggcggtagtgcgcgccatgtatccgtacattgagcgtgaactcagccagggtacgtatctcggccatattacccggcatatgctgggcttgttccagggtattcctggcgcgcggcagtggcggcgttatttaagtgaaaatgcccataaagcgggtgcagacattaatgtgctggaacacgcgctcaaactggtggcggataagcgttaacttttcaccaaaaagtagtcaaattcaccacgccctgcgccccgtcgcggggcgttttgctgttaaatcaatagattatttttggcatgattcttgtaatgccagcaagagatttcatatttgggagagcatcatgctggaactactttttgtaattggcttttttgtcatgctgatggtcaccggtgtttcgttgctgggtattatcgccgcgctgattgtggcgacggcctttatgttcctcggcggtatgctggcattgatgattaagttgctgccgtggctgctgttggcggttgcggtggtgtgggtgatcagggcgattaaagcaccaaaagtgccgaaatatcagcgttatgaccgctggcgttactaagggattgtgcggatgatcacaacctaaggttttatccttagaacaaaataggaattgataatcaaatctgtcactattgcgcgtcaaacaaattcatcgagctgtaccctacatacagccgaactataaaagaaagggcttcccaggtggaagcccaatttcttttatggaatcaacaggctggaaccctgcgtcgcccggctttccagaatctcatgcgcacgccgcgcatccttcagcggatatttctgctgctcggcgacatcgaccttaatcacaccgctggcaatcaaagagaacagttcattactggcctcggttaattcctcccgcgtggtgatatagccttgcagggaagggcgtgtcacatacaacgagcctttctgattgagaatgcctaagttcacaccggtaaccgcacctgatgagttgccaaagctcaccattaagccgcggcgttgcaggcaatccagcgaccgttcccaggtgtctctgcccactgaatcgtacaccacgcgcactttcttaccaccggtgatctctttcaatcgctcgaccagattctcttcacgatagttaataacctgccacgcgcccgcttttagcgcactctgcgctttttgcgcggttcctacggtgccgataagtttcgcgcccagggcttttgcccactggcaggcaatcaagccaacgccgccagccgctgcgtggaacaggaattgttcatcgggtttaatttcataggttttgcgcagcagataataaaccgttaagcctttcaggaaggatgccgcagcttgctcaaaagaaattgccgcaggcagaatcgccgctttatccgcattaatgttatgcacagagctgtaagcgcctaatgccgattgtgcatagactacgcgatcgcctgccttaatatgctttacaccactgccgactttactcacgatgcctgccgcttcagtacctaatccgctgggtaacgatggtggcgggtaaaggccgctgcggatatatgtgtcgataaaattgatgccgatggctttattttcgacctggatttcattctccgccggatcggcaggagtgaactctacggcttgaagtacttccgggccaccgtgcttgtgaaattcaattcgtgttgccatgtgtcctccagaacgtatcgtcagggtctgcttcatatggtaaagtttcgacccattctttatctcggtaactccattcactatggcaggaaataaacccttcaacaaacagcaggctgaaccccgcgaacgcgatccacaagttgccgggctaaaagtgcctccgcactcgatcgaagcggagcagtcggtgttgggcggtttaatgctggataacgaacgctgggatgatgtagccgagcgtgtggtggcagacgatttttacacccgcccacaccgtcatatctttactgaaatggcgcgtttgcaggaaagcggtagtcctatcgatctgattacccttgcggaatcgctggaacgccaggggcaactcgatagcgtcggtggttttgcttatctggcagagctgtcaaaaaatacaccaagtgcggcgaacatcagtgcatatgcggatatcgtgcgcgaacgtgccgttgttcgtgaaatgatctccgttgctaacgagattgccgaagctggttttgatccacaagggcgtaccagtgaagatctgctcgaccttgctgaatcccgcgtctttaaaattgccgaaagtcgtgcaaacaaagacgaagggccgaagaacatcgccgatgtgctcgacgcaaccgtggcgcgtattgagcagttgtttcagcagccacacgatggcgttaccggggtaaataccggttatgacgatctcaacaaaaaaaccgctggcttgcagccgtcggatttgatcatcgttgccgcgcgtccgtcgatgggtaaaacgacatttgcgatgaacctcgtcgaaaacgcggcgatgctgcaggataaaccggtgcttatcttctcgctggagatgccatcagaacagatcatgatgcgttctctggcgtcgctgtcgcgcgttgaccagactaaaatccgtaccgggcagctcgatgatgaagactgggcgcgcatttccggcaccatgggtattttgctcgaaaaacgtaatatctatatcgatgattcctccggcttgacgccaacggaagtgcgttcccgcgcacgccgtattgcccgtgaacacggcggcatcgggcttatcatgatcgactacctgcaactgatgcgcgtaccggcgctttccgataaccgtacgctggaaattgcagaaatctcccgctcgctgaaagcactggcgaaagaactgaacgtgccggtggtggcgctgtcccagttgaaccgttctctggaacaacgagccgacaaacgcccggtcaactccgacctgcgtgaatctggctctatcgagcaggatgcggacttgatcatgtttatctatcgtgatgaggtgtatcacgaaaacagtgatttaaaaggcatcgcggaaattattatcggtaaacaacgtaacggcccaatcgggacggtacgcctgacctttaacggtcaatggtcgcgcttcgacaactatgcggggccgcagtacgacgacgaataataattattttatgaattaggtaattaaagcaaacacttatcaaggaacacaaatgcaagcggcaactgttgtgattaaccgccgcgctctgcgacacaacctgcaacgtcttcgtgaactggcgcctgccagtaaaatggttgcggtggtgaaagcgaacgcttatggtcacggtcttcttgagaccgcgcgaacgctccccgatgctgacgcctttggcgtagcccgtctcgaagaagctctgcgactgcgtgcggggggaatcaccaaacctgtacttttactcgaaggcttttttgatgccagagatctaccgacgatttctgcgcaacattttcataccgccgtgcataacgaagaacagctggctgcgctggaagaggctagcctgaacgagccggttaccgtctggatgaaactcgataccggtatgcaccgtctgggcgtaaggccggaacaggctgaggcgttttatcatcgtctgacccagtgcaaaaacgttcgtcagccggtgaatatcgtcagccattttgcgcgcgcggatgaaccaaaatgtggcgcaaccgagaagcaactcgctatctttaataccttttgcgaaggcaagcctggtcaacgttccattgccgcgtcgggtggcattttactctggccacagtcgcattttgactgggtgcgcccgggcatcattctttacggcgtatctccgctggaagatcgctccaccggtgccgattttggctgtcagccagtgatgtcgctaacctccagcctgattgccgtgcgtgagcataaagccggagagcctgtcggttatggtggaacctgggtaagcgaacgtgatactcgtcttggcgtagtcgcgatgggctatggcgatggttatccgcgcgccgcgccgtccggtacgccagtgctggtgaacggtcgcgaagtgccgattgtcgggcgagtcgcgatggatatgatctgcgtagacttaggtccacaggcgcaggacaaagccggggacccggtcattttatggggcgaaggtttgcccgtagaacgtatcgctgaaatgacgaaagtaagcgcttacgaacttatcacgcgcctgacctcaagagtcgcgatgaaatacgtggattaatcgttctttaatatttgattgtctgtgccggatgcggcgtgaatgccttatccggccaataaaatcttaccaattcaataagttgatattctttcatgctcttataaaggtcgtgcatctggcggatgtacgtttgtcatgagtctcactctgttgctaattgccgttcgcccctgaacatcctctcgatcttcgccttcttccggtttattgtgttttaaccacctgcccgtaaacctggagaaccatcgcgtgtttcaaaaagttgacgcctacgctggcgacccgattcttacgcttatggagcgttttaaagaagatctccgcagcgacaaagtgaatttaagtatcggtctgtactacaacgaagacggaattattccacaactgaaagccgtggcggatgcggaagcgcgcctgaatgcgcagcctcatggtgcttcgctttatttaccgatggaagggcttaacagctatcgccatgccattgcgccgctgctgtttggtgcggaccattcggtactgcaacaacagcgcgtagcaaccattcaaacccttggcggctcaggggcattgaaagtgggcgcagatttcctgaaacgctacttcccggaatcaggcgtctgggtcagcgatcctacctgggaaaaccacgtagcaatattcgccggggctggattcgaagtaagtacttacccctggtataacgaagcgactaacggcgtgcgctttaatgacctgttggcgacgctgaaaacattacctgcccgcagtattgtgttgctgcatccatgttgccacaacccaacgggtgccgatctcactaatgaccagtgggattccgtgattgaaattctcaaagcccgcgagcttattccatttcttgatattgcctatcaaggatttggtgccggtatggaagaggatgcctacgccattcgcgccattgccagcgctggattacccgctctggtgagcaattcgttctcgaaaattttctccctttacggcgagcgcgtcggcggactttctgttctgtgtgaagatgccgaagccgcaggccgcgtactggggcaattgaaagcaaccgttcgccgcaactactccagcccgccgaattttggtgcgcaggtggtggctgcggtgctgaatgacgaggcattgaaagccagctggctggcggaagtagaagagatgcgtactcgcattctggcaatgcgtcaggaactggtgaaggtattgagcacagagatgccagagcgcaatttcgattatctgcttaatcagcgcggcatgttcagttataccggtttaagaaccgctcaggttgaccgactacgtgaagaatttggtgtctatctcatcgccagcggtcgcatgtgtgtcgccgggcttaacgcgcaaaatgtgcatcgcgtggcaaaggcgtttgctgcggtgatgtgattttaatcaacaggcggatctctccgcctgttcctgactccagccacaccctactattctgtcccttttttcgcccacttttacatcatctcttttctataagcttttgaaaattagtgtttttaactgttggtacggattgtgcagtaatgcggctgtctatgaccatcaggagaaaaacatggagaacatgacctcgcccggcacgctgcttagtggagataacgcgacctggcttgaagagtactaccagacctggttgcgtacgccggaaaaactcccggaagactggcggcgtttttttctttcacctgaactgactgtccaaagcgtatccggtgataacaacgtcagcggtgcgacgttaaaaaaacaggctgcggtaatacaactgatcaatgcctggcgcacgcaggggcatctgcgcgcaaagcttgatccacttggtttgaatcccccggctgacgttccctccctccagcctggtttttggggattaagcgaagaagacttgttgcaggaatttagcgtcacctttggcgcacacaccacgcaaatgccacttaagcaactgcttaacctgctggagcaagcctgggcgggtagccaggcttatgaacttgctcatctggaaaatcgtgaagaaatcaactggttgttatcacggattgagagcagcaatgcgccacaagcagatgtacaaacctgtattgctcgttttgaaaaactgatggcggcagagacgttagagcgttatctgcatacccgttatgttgggcagaaacggttttctctggaagggggcgaaagtgcaatcccggcgctcgatacgctgacaaaacgcctgcgtgcgcaaggtgtggaggaaatggtcattggcatggcgcaccggggaagacttaatgttctggttaatctgttgaataaagacccggcacagctttttgctgagtttgaaggcaagcagacgatcggcagtggttcaggcgatgtgaaataccacatggggtattccagcaatctggaaacacctgccggttcgctgcatgtggcgctggcgtataacccctcacatctggagatcgtgaatccggtggtgctgggccaggtgcgagccaggcaggaacgccgtggtgaggatggtcaggcaaaagtggtgggcgtacttattcatggggattccgcgttgggcggcctcggcgtcaaccaaaccacgtttaacttatcgcagactcagggctacggcactggcggtacgctacatctggtgattaacaatcagattggcttcaccacttcccgcttgcaggatatgcgttcttcacggtactgcaccgatattgccaaaatggtagcggccccaattatccacgttaatggcgatgacgttgacgctgtttgccaggtaatggaactggcgtgcgaatggcgagacaccttccggcgcgacatcatcatcgatatttgctgcttccgtaagcacggacacaacgaaagcgatgagccacgtcttacccagccacaaatgtatcaggcagtggatgctcaccctggtacgctcgcccgttatggtgaatctcttgcccgccgcggcctgttaactcaggcgcaacaagattagatgacggcacgctatcgcgactggctggatagctgccagaaacgtgaaccgcagcctctcaaacctgcaattcactcttttagcgctaactggtatgggttgaccaaccctcactggagcgccccggtatctacggcattgcctcggcaaaagctggcagcgtatggtgaaatcatttctacactgccacccgatgtggtcgcacatcctaccattaaacggcaactggcgttacgccaggatatggccgcaggtactcagccaatagactggggaatggctgaaatgctggcctatgcatcgcttgtggatgcgggtgttggtgtgcgtctttctggtgaagactcagggcgtggcacgttcagtcatcgccatgcagtggtacatcatcaaactgaagcccgtcgttatctgccgttacagcatatccgcgctggtcaggcatctttcgatgtttatgattcggtgcttaatgaagaagcgctcttagcctttgaatatggctattcaacgtctgcgcctcagcaactggttatttgggaagcgcagtttggtgactttgccaacggcgctcaggttgctattgaccagtttatctcgtctggcgaaaccaagtgggatcgctatagcggtttaaccattcttctgccgcatggctatgacggacaagggccggagcactcttctgcgcgtcctgagcgctggctgcaactgtgcgcagaaaacaacatgcaggtggtgatgcccagtgagtcagcacaaatgttccatttgctgcgcggtcaggcattacgcccaatgcgcaaaccgttagtgataatgatgagtaagcgtttacttcgttttaaaggcgctatgagcgagctttgtgaattcactgatggcgcttataaaccggtaatcaccgatccgcaattgcatcagtcccagaaagttaagcgcgttattttgtgtagcggccaggtctattacgacgtactggaagcccgtaagcagcgtgagcatgaagacgaagtggcgattgttcgcctggagcaactctacccgttcccggtcgcagaactgaatgatgttctggcgagttggccgaactgctgcgaatggatttggttgcaggaagagccagaaaaccagggcgcgtggcggcagattcgtcatgagctggcggcactgaaaattaacactccttactggcagtatgcaggccgcccggcagcggcagctccggcgacagggtatgggcgtgtacataaacaacaaatcgacgaatttcttgctgctgcgtttgcagatattcagccatgaaaggcgcacaaaaataataaggaaaacattttatgatcgaaattactgtccctgtattaccggaatctgtcacggaaggcacgctgacaacctggtgtaaacaagaaggcgagcacgtaaaacgcgatgatgtgattgccgagctggaaaccgataaagtcattctggaaataccggccccgcacgatggcgtgttaagcaatattatcgtcagcgaaggtagcacggtcacgtccgcgcaactgttggcgcatcttaagccgcaagctgtcatagaagaaaccgtcacaccagtcaccgaaaccctggcgatgccttccgcacggctggaggcacagcgtagtggtgtcgaacttgctgacgttgcggggagcgggagaaatggacgtatcctgaaagaggatgtacagcgcgttactcctgcaccagtcattcagcctgaacgggtggcggagatcgcgccagctaaacccttgacaccgggtgctcgtcaggaacgtcgtgagccgatgtcgcgcttacgtcagcggattgctgagcgtctgctggcttcccaacaaaataacgccattcttaccacattcaacgaagtaaacatgcagagcgtgatggatttacgcgcccgctggaaagatcgttttgccgagaagcacggcgtgaagctgggctttatgtccttctttgttaaggccgttacccgggcgctggagcgcttccctgtagtgaatgccagcgttgatggcaacgagattatctggcgtgattattgcgatatcggcattgcagtgagcagcaaccgcggcctggtagtgcctgtgttacgcaatgcgcaatcactctctttggtggaaattgaacggcaaattgccgaatacgccacacaggcacgcaatggcaaattgccgctggaggcgttacagggcggcacgttctctatcaccaacggcggtacttttggttcgatgatgtcaacgccaatcattaacccgccgcagtcggccattcttgggatgcatgccatcacgccgcgcccggtcgcagaaaacggccaggttgttattcgtcccatgatgtaccttgctctcagctatgaccatcgcattatcgatggtcaggaagccgtgcagacattggtggcaatacgtgagctactggaatcaccggaacaactgttgctggatctttaaggagggcgccgatgagtacaatttttgatgtggcagttatgggggggggccaggtggttacgtagcggcactgcgggctgcgcagaatgggctttccgtagtatgtattgatgatggtgttaatgcacagggcgaaccttcgccgggcggtacgtgtctcaatgtcggctgtattccgtcaaaatcgttgctgcaatcttccgaactgtacgcgcaagtgcagcatgaggcgagcattcatggcgttaatgttgacggcgtatctttcaatgcagctgcgatgattcaacgtaaagacgccatagtaagccgcctgacaatgggcatcggcttgctgtttaagaaaaataaagtgaagtacctgtgcggcctcgcaacgttagaacatgctcgggatgagatttggcaattacgtgtaaacgatcaacaaatccgcgcccgtaatgtggtgattgcaacaggttctcagccgcgtcaactgcctggcgttaccattgataatcagcaaattctcgataatcgcggcgccctggcgttaaccgctgtgccgccgcgtctcggtgtgatcggcgctggcgtgattggccttgaactggggtctgtgtggaatcgggtcggttcagacgtcacgttgctggagatggcgccaacgttcttgcctgcactggaagctcgcctgtcgaacgaagtccgtaaagcaatgattgccagtgggatgaaaatgcaactggcagtagagattgaggctattgaacaacgggatgacggtgtgcatgtgcgctggcggcagggtgagaagcgagaagaaagccgcttcgataaattaattcttgccattggacgtgtaccgcgactttctggtgtcgatctcgtgcaactcggtcttgaagccgacaaccgtggcggtattgccgtcgataacttatgccgtaccgggaaagccgggctgtgggcaattggtgatgtcgtgcgagggccgatgctggcgcataaagcgatggctgaaggtgtggtagttgcggatcaaattgccggactggcggtagagccgattaattttgcgctgatcccttcggtgatttacacccaaccggaagttgcgtgggtaggggaaaacgaggcctcactgaaagccgctggcagagtctttaacaaaggaaattctctgtttgccggtaacggtcgcgccttagcattaggccaggaaggtgggcgttgcacgttatacagcgataaacacactgaccgcgtacttggcggagcgattgttggcccgcaggcatcggagctgatcaatgaaattgcgctggcgatgacttttagcgcctctggcgaggatattgcctgtgcgatccatgcgcatccgaccttaagcgaagtcatccacgaagcagcaatggccttgaataataaagcattacacggataacacataccactgagggaatatatgaatttacatgagtatcaggccaaatcgttactggctggcatggggatgccgtgtccaaaagagatagccatccaacagatttcgcaactggcagatgcctggcaacatattgcttgcccgagtaaaggcgcggtacttaaagcgcaggtacatgctggtgggcgcggtaaagctggcggcgtaaaagtgcttaagcagctgccggaagcacaggcttttgtacagcaaatgttgggatcgcaactggtgacttatcagaccgggccagaagggcagtatgtcagcagtattttgctgtgcgaaaacatctatccggtacgccaggaactctattttggcatggtggtggatcgtgaaagccagcgggtcacgtttattgtcagcccggaaggtggtgtggaaattgaaaaagtcgcccatgagacaccggagaaaatcagcagtgtcagcattgatccactgacaggcgtgcagccttgccatatccgcgaaatgtttgctgttctgcaactggaacacgggctatttgctgcctttagtcgcctggttaatcaggcgtggaaagcctttaacgaactggatttcgccctgctggaaattaaccctctggtgttgcgggaaacgggcgaatttatgtgtgcagacgcgaaagtatcgctggatgataacgcgctgtatcgtcacccggaactccaggtgctacgtgatgaaacccaggaagatccacgcgaaagccaggcagcgaagcttgatcttaattatgtctcgctggacggaaatatcggctgcatggtcaatggtgcagggctggctatggcaaccatggacatcatcaagctatacggtgaacaacccgcaaacttcctggatgttggcggtggcgcaacccaggagcgcgtcagtgaagcctttcggctgattgtttccgacagcaaagtgaaagccattctggttaatatttttggtgggattgtccgttgcgacatgatcgccagagccattattcatgctctgaatgaggcccgtatcaccctgcctgtcgtggtgcgtctctccggtaataacgctgccgaagggcagcggttactggcagaaagtggcctgacggtggaagccgtcaattctctggatgatgccgctaaacgcatcattgcgttactgaattaacaggaggttaagatgagcgttttgatcaacaaacacacgcgggtactggtgcagggcattaccggcaaaaacggcacatttcatacagagcaggctattgcgtatggcacgcagattgtgggtggagtgacgccaggtaagggcgggcaacggcatctggatcgcccggtttttgattcaatgaaagaagcgatgcgacaaactgaggctgatgccagcgtgatttatgtgcctgcaccgtttgtgctggattctgttgttgaggctattgaagctggcgtcaaattggttgtggtgatcactgaaggtgtaccgacactggatatggtgaaagttcgtcggctgcttgactgccacccggatgtgcggctgattgggccaaactgcccaggagttatcacgccgggcgagtgcaaaatcgggattatgcctggtgaaatccaccgcccagggcgtattgggattgtttcccgctccggtacattaacctacgaagctgtagcgcaaaccacggcgctgggacttgggcaatccacctgtattggtattggcggcgatccggttccggggactaactttattgatgcgctgcgtttattcgaaaatgatccgcaaacagacgcggtaattatgatcggtgaaattggtggtaatgcggaagaacgggccgcggaatttattcgtgatgaaatgaataaaccggtcgtaggttatattgccggtgttactgcaccaaaaggaaaacgcatggggcacgccggagccattatttctggcggtagcggcagtgcagaggataaattccgtgcgttcgataaagcaggcatggcatggacaagaaacccggcgttgcttggcgaaacgttatggaatgttattaagtaatccataaatgaatatcaagggagcatatcgctccctttttttatctgtgtggtaagagaatcaccttttatttactgtgcggaaaaccgcgcacaaaataaaaagaataaataataaaatcattaaataacaaagcgttattaaaaaattaaagatggcatagctcctgcaatagccaggcaggttttttatttttcacaatgaggtgaatatgtcatcaatatcccatggcgcaccacaaaagcgtcgaattatccctaatcccggcctgtggttggcgatcattgccggaattattattacccttctgccactgggcgataccttgcccgtcgctggacaaaatatgatcgccattctggtgtttgccattattgtctggatcagcgaagcgatggattacaccgccagtgcaattgttatttccgcactgattatctttatggttggttttgccccggatatgaatcacccggacacgatccttggcaccgcgaaagcgctgaaaatgactctgtcgggtttttctaattctgctctggcgctggtggcagcagcaatgtttatcgcggcggcaatgaccattaccgggctggataaacgcattgcgctgtttactatgtcgaagataggtgccagcagccgcagcattattatcggtgccattgtggtgaccatcgtcctgagcctggttgtacccagtgccactgcccgtacggcttgcgtggtgccgattatgatgggggtcattgcggcatttaaggtggataaacattcacgtttagcggcgtcaatgatgattgttatcgcccaggcgaccagtatctggaacgttggtattcaaacttcggcggcgcaaaacctgctttctatcggttttatcaataaaactttcggcgccgggcattctgtcagctggcttgactggctgttagcgggcgcgccctggagcctcaccatgtcggcgatcctctatttcctcgcacgtaaattgttgccgccagaaacggaagctgttgaaggggggagcgaggccattaaaaaagcacttgcagagttagggccaaccactggtaaagaaaaacgtttgatcggtatttcgctattgttactgctcttttggtctactggcggaaaattacacagtattgataccacctctgtcacccttgccggactggcgattatgttgctgccaggcatcggtgtaatgagctggaaagaggtcgaaaaacgtgtgcagtggggcacgttgcttatgtttggtattggtatcagcctggggtccacgctgcttgatacgcaggcagcttcatggatggcgaactatgtggtgaaaggttttggtctcgatggcttgccatcattagccatcttcgcgattctcgccgctttcttgataattattcacctggggtttgccagtgccactgcgctaactgccgcattgctgcccatcctgattagcctgttaagcagtctgccgccagaactcggcgttaacccggtcggcatgaccattctgctcgccttcagtgtcagttttggcttcatcctgccgattaacgcgccacaaaatatggtgtgtatgggtacggataccttcacgccacgccagtttacccgtgtgggactgtacctgacggtgatcggctacctgttgttgctactgtttgccgccacctggtggaaaattttaggtctaatgtgaggaaaccaacgatgtcattacaaattgctgttgaaaaagtgcgttggttagctgccgggctgctggaacttaatggctgtgatgccgatatcgctcaggatgtggcggaacatatgattgaagcggaacgttatggctttgccagccacggcgtcacgctgctaccgaaatatctggaaaatatcgctcgtggcgatgtaaccgcgaatgcccgcccggaatgcttaacaagtgaaggtaatttacaacgttttcatgcccacaatggctttggtcaacacgccggaaaagtggcggtaaatgctgccatcgaacaagcaaaacaccgcggtttttgcctgttaacgttgtgccatgcgcatcatttagggcgtatggggcattacgggcaaatggttgctgatcaaggcctggcgatgctggccatgagtaacgtcaccgggcgtcctgcactggtcgccccgtggggcggtgcggaaccgcgtatgaccactaaccctttctgctttgcctggccgttcagtgatgggcgtccgccgattctggttgattttgccaccagtagcatggcgctaaataaagcacgggtaatgtcgtccaccgggaagcaggccgcgccgggacaattgattgatgcacaggggaatccaagcaatgatcctggggtgttattcagcaatcctccaggggcgttactgccatttggtgagcataaaggatttggccttgcactgatgattgaaatgatggcggggatcttatctggtggtgacacgatcgccgaagatcatcagacggatggatctgcgcataatcatctttttgcgttgattatcgatcctgatcaattcaccgactggcaggggagaaagggcagttctttgcggattatctgttagctacgcagcctcaacctggcggcaatccggtgatttaccccggtatgccagaagctgccaaccgggaacgcaatgcgaagatgattacgatcccggtatcattctggtcctgggtagttgaacattacgcccgcaaaggtatcgatttggggttacatcctcaggaatcagcattagctggatgattctggtcgataaacttgcggttgaatctgatgtttgttgagtttgtcatataaagtcttgcgcggcagctgtaatagccgcgctgtcaaactgacctggccttccgtttgtcgcagcatatcttcgattaactttttctcgaaagcatcaatgcaggcggtaagaccactctcttcttgctgagtcattggcactggctggtggtgggtcagtaaaccgagaacaaaacgctctgcattgtgtttaagttcacgtacattgccaggccaactttgtgactgcaaccaggccagtaacatgggagaaatatcaggcagaggacgattatatttttgtgccgcctgactggcgaaccagtaaaacagttcagggatatcttctcgtcgctggcgtagaggtggaatattcaggctaaccacattcagacgataatagagatcgagacgaaacagatgttcttcgctgcgacgcagtaaatcttccttggtcgctgcaataacacggcaattcaccggaattaattgattggcacctaatcgttcaatggttctttcctgcaatacacgtagcagttttacctgcattcctgatggcattccctctatttcatcgagaaataacgtaccaccatttgcatgttcaatttttccaatacgctttttaaccgcaccggtaaatgcgcccgcctcatgaccaaatatttcgctttcaaacaacgtttctggtaagcctgcacagtttaaggcaacaaactgcccctgacggcgggtactccagtgatgcagcattctggcgacgacttctttaccacaacctgtttcaccataaataaggacatcggcaccggtatctgcgacattaaggatcattttacgcagttgttgcatctgcggactacgaccaatcagcaccgggccattttcctgttgcagattcgccagtaattgctgattttctaaaaccaatcgccgtttttctaccgctctggcaataatactcaataatttatctgagctacttggtttctcaatgaaatcgaatgcaccattacgcatggcatccaccgccatttccacgtcaccgtgtccggtaattaaaataaccggaattttgctatccatttcgttgatgtaactgaggagctctagtcctgatattccaggtaacctgacatcggtcagtataataatgttggcctgactttgaataaggggaatactgtgttctgcatcgcaacaggaaataacacgataaccagccagcgtgagcgtttgttcacaggcaaaacgtacatcgtcactatcttcaatataaactatagtaatttcactggatttattattcatgttcttctccccattcaggccaggttaatgtcattactgcgccgccttcaggatgattactggcgtggagtgcgccgttcgaatttcggacaatttcgctgactattgccagtcccaaccccattcctctacgtttagtggtaaaaaatggttcaaatatgcgatcgacaacttcaggtgcaaaaccgccaccgctgtctttaatggtaataataactttgttatttgcctggcgaatggcgatatccagtcgtttgtaagagctaccttccatagaatctaaggcgttgctaattaaattactgaatatctgttcaagaccgagctcatcgcaattgacaaataacggcatggatggggcttttattcgtcgctcaatgttatttttctccatgctgtgattaagtaacgccacggcgctatacatcactttgatgacatcggcagaacctttaggtacgcgatggcgcgaggcaaatgctttaagttcggaaatgagctgcgtcatccgctcaatcactgaaataatgtgtttcagattctgttcaacctgcggatacatctctttttttagcatagtacgcgcgttatcagtaagtgcgtgaatggcggctaacggttgattttgttcatgggcaatttcggttgccatctgtccaagcgccgccagtttgctggactctgccagttcactacgcgtaatttgtaatacttgttcagcctgactgcgctcttttatctcctgtattaatttttgattgatcaattccaggacagatgtacgctctttaacctgtttttctaatgtttcattcgccagtgttaataattgttgtgcatgagatcgcattctccagtatttaataaataacaaaaacagcaggtaaataattagtgtaatgactaacgaaatagcccatgaccagtacaggttatctaaggggaccataattgtcattttccagttaaactctggaatggcgatttgttgcgtataatactgcgggaataagcagaattgttcttttttatctttcaggaaagtaaaattgctaacggtaaaacaagggtaataatccgcaggtaaaagattgtccaggctatattgacgggtagattgaagtttttgttttgcctgaacaggtaacggttgcagcgttctcattcgccatggcgattttgaacttaaaaatataatcctatgttcatcattaacgataatgttttcaggaccttcggaccatgctttttcaatttcattaagacttatttttactactacaacaccgacaatttttcctttatcttttatacttgtagagaggaagaatcccggtgtatttgtagtgctaccaataccgtaaaagcgtccatttaagccagacatggcgtgtttataataggggcgatagctataattttgccctacatagctgccggggtcctgccagttgctagaagcgatggccttaccttgggtatccagaataaatattgctgcggttttgagttgagtattgaaatgtgcaattcgttgattgagttcgctggacgtcatatcgtcaggcgtaattaccgcctgacggatgatatggtctgttgagagcatatagggtaaaacataaaattgctcgatggtggaatataatgtggacttatacatttcaagccgcattttatcggtaccggacaaggtattaaaacgcaagtgcaaaaaagcgattgaaaccgcgagcatgataagaaaaagtgaaatgcttgtaatgtgaaatcgccatttgttcttaaatatataattccacgatattttcattcatcatccattgaatgcatttatatttatcatcagtatattccctgaacaatgtttgcgagaaccaaaagagtgccattgtgtgaatgtgtaagcagaataaccgtggcaatgtgtggtttatcgcacaggtattccaaatgtgatcatgctctttttatgtgacaaatccgcagataatccttcctttcccccgcggttggcgttatggtcagatggttttttcaacaaacgcacaataataagtttcaacttactgactatttagggaaaaatatgcgcaagatcacacaggcattgagtgccgtttgcttattgttcgctctaaacagttccgctgttgccctggcctcatctccttcaccgcttaatccgggtactaacgtagccaaactcgctgaacaggcgccaattcattgggtttcggttgcacaaattgaaaatagcctcgcaggacgtccgccaatggcggtggggtttgatatcgatgatacggtacttttttccagtccgggtttctggcgcggcaaaaaaaccttctcgccagaaagcgaagattatctgaaaaatcctgtgttctgggaaaaaatgaacaatggctgggatgaattcagcattccaaaagaggtcgctcgccagctgattgatatgcatgtacgccgcggtgacgcgatcttctttgtgactggtcgtagcccgaccaaaacagaaacggtttcaaaaacgctggcggataattttcatattcctgccaccaacatgaatccggtgatctttgcgggcgataagccaggtcaaaatacaaaatcgcaatggctgcaggataaaaatatccgaattttttatggtgattccgataacgatattaccgccgcacgcgatgtcggcgctcgtggtatccgcattctgcgcgcctccaactctacctacaaacccttgccaccagcgggtgcgtttggtgaagaggtgatcgtcaattcagaatactgacagagcgggagagcgtaatactctcccgaatactgtttttttaatcacacctttatcctttcgctgtcttgctgcaaactgattaagagagttttatcaaggagcagcacatgtggtatcaaaagacgctcacgcttagcgccaaatctcgtgggtttcatctggtaacggatgaaattctgaatcagctggctgatatgccgcgcgttaacatcggcttactgcatctgttgctgcaacatacctccgcctctctgacacttaatgagaactgcgatcccaccgtacgccacgatatggagcgttttttcctccgcgccgttcccgataacggaaattatgagcatgactatgagggagcagacgatatgccttctcatatcaaatcctcaatgctgggaacatcgcttgtattgccggtgcataaagggcgtattcagaccggcacctggcaaggcatctggctgggggaacatcgcatccacggcggatcgcgtcgcatcatcgcgacactacaaggggagtgaaaaatgaccatttcggagttgctacaatattgcatggcaaaaccaggcgcagaacagagcgtgcataacgactggaaagcgacgcagatcaaagtggaagatgtgctgtttgcgatggtgaaagaagtagaaaatcgcccagctgtttcgctgaaaaccagcccggagctggcggagctgctacgtcagcagcacagcgatgtgcgtccaagccgccatctgaataaagcgcactggagcaccgtgtatctcgacggttcgctgccggattcgcaaatctattatctggtggatgcgtcttatcagcaggcggtgaatttgctgccggaagaaaaacgtaaattgctggtgcaactctgaaagaagaaggccgctctgaaagcggccttaacgattacagcatcggcttgaggaagcgcgccgtatgcgaagcttcgcactctgcgacggtttctggcgtaccggagacgaggatttcgccgcccccactgccgccttccggtcccaggtcgacaatccagtcagcggttttgatcacgtcgagattgtgctcaattaccacaatggtattgccctgatcgcgcagtttatgcagtacgtcgagcagttgctgaatatcggcgaagtgcagaccggtggtcggctcgtcgagaatatacagcgtctgcccggtgccgcgttttgacagctcacgcgccagcttcacgcgctgggcttcaccaccagaaagtgtggttgcggactgcccgaggcgaatgtacgtcaggccaacatccatcagcgtttgtagcttacgcgccagagctggcaccgcatcaaagaactcacgcgcctcttcgatggtcatatccagcacttcgtggatggttttgcctttgtacttaatctccagcgtttcacggttatagcgtttgcctttgcactggtcgcacggtacgtaaatgtccggcaggaagtgcatctccactttgatcacgccgtcgccctgacaggcctcgcagcgtccgccacggacgttaaagctgaaacgtcctggcgtatagccgcgcgcacgggattccggtacgcccgcaaacagttcgcgcacaggcgtaaacacaccggtgtaggttgccgggttagaacgcggagtacgaccaattgggctttggtcgatatcgatcactttatcgaaatgttccagtccctgaatatcgcgatacggtgccggttcggcgatggtcgcaccattcaactggcgttgggcaatcgggaacagtgtgtcgttaatcagcgtcgatttaccggaacctgaaacccctgtgatgcaggtaaacagacctaccggcagcgtcagcgtcacgtctttcaggttgttgccgcgtgcgcccgtcagtttcagcactttttctggattggcgggtacgcgtttcttcggcacttcaatcttgcgtttaccgctcatgtactgcccggtcaacgactctggcaccgccattattgcttccagcggaccttccgcgacgacttcaccgccgtgtacacccgcacccggaccgatatcgatcacatgatcagcggcgcgaatcgcgtcttcgtcgtgctccaccacaatcacggtattaccgagatcgcgcagatggataagcgtacccagcaggcgctcgttatcgcgctggtgcaggccgatagacggctcatccagcacgtacatcacgccaaccaggcctgcaccaatctggcttgccagacgaatacgctgggcttcaccgccggaaagtgtctctgccgagcgggaaagtgtcaggtaattcaggccgacgttaacgaggaatttcagacgatcgccgatctctttaaggattttttctgcaatcttcgcccgctgacctgcgagtttgagattgttgaagaattccatcgcatgaccgatgctcatgtcggagatggcgggcagcggcgtattctcgacatacacgtggcgtgcttcccgacgcagacgggttccttcgcagctggcgcacggacgattgctgataaacttggctaattcttcacgtaccgcactggattccgtctctttataacggcgctccatattgtgcagcacgccttcgaacggatgacgacgaatggaggtatcgccacgatcgttcatgtatttgaattcaatattttctttgccagaaccgtacaacaccactttatgcacgttcgtgctcaggctgccccacggcgcttcgacgtcgaacttatagtgatctgccagcgatttcagcatctggaaataatagaagttgcggcgatcccagccacggatcgcaccgccagccagcgacaattccggattctggatcacgcggtcaggatcgaaatattgctgtacgccaagaccgtcacaggtcgggcaggctcccgccgggttgttaaatgaaaacaggcgaggttccagctcgcgcatactgtaaccgcaaatcgggcaggcaaagttggcggagaacagcagctcttccgctttcgggtcgtccatatccgccactaccgcggtaccaccggaaagctccagcgcggtttcaaacgactcggcaagacgttgggtaagatcgtcacgcactttgaagcgatcaaccaccacttcaatggtatgtttcttttgcaattccagtttcggcggatcggaaagatcgcagacttcgccatcaatacgagcacggatgtaaccctggcttgccaggttctccagcgttttggtgtgttcgcctttgcgctctttaatgattggcgcgagcagcatcagacgcttgccttccggctgggacaacacgttatccaccatctgactgacggtttgcgccgccagcggtacatcgtggtccgggcagcgtggctcaccaacgcgagcgtacagcagacgcaaatagtcgtggatttcggtgattgtccccaccgtagagcgcgggttatgagacgtcgatttctgctcaattgagatggcaggagaaagcccctcaatatggtcgacgtccggcttctccatcagtgacagaaactgccgcgcgtaggcggaaagggattcaacgtaacgacgctgcccttcggcatataaggtgtcgaaagcgagcgaggatttgccagaacccgaaagcccggtcacgacaataagcttgtcgcgggggataacgaggttgatgtttttgagattatgggtgcgggcgccccgaacttcgatcttatccattcacctttcccggattaaacgcttttttgcccggtggcatggtgctaccggcgatcacaaacggttaattatgacacaaattgacctgaatgaatatacagtattggaatgcattacccggagtgttgtgtaacaatgtctggccaggtttgtttcccggaaccgaggtcacaacatagtaaaagcgctattggtaatggtacaatcgcgcgtttacacttattcagaacgatttttttcaggagacacgaacatggccagcagaggcgtaaacaaggttattctcgttggtaatctgggtcaggacccggaagtacgctacatgccaaatggtggcgcagttgccaacattacgctggctacttccgaatcctggcgtgataaagcgaccggcgagatgaaagagcagactgaatggcaccgcgttgtgctgttcggcaaactggcagaagtggccagcgaatatctgcgtaaaggttctcaggtttatatcgaaggtcagctgcgtacccgcaaatggaccgatcaatccggtcaggatcgctacaccacagaagtcgtggtgaacgttggcggcaccatgcagatgctgggtggtcgtcagggtggtggcgctcctgcaggtggcaatatcggtggtggtcagccgcagggcggttggggtcagcctcagcagccgcagggtggcaatcagttcagcggcggcgcgcagtctcgcccgcagcagtccgctccggcagcgccgtctaacgagccgccgatggactttgatgacgatattccgttctgatttgtctttaaaacaataggttatattgttttaaggtggatgattaaagcatctgccagccataaaaaagaagcctccgttatggaggcttctacatatcaagtcaaaatcattggccattgtggcggtgtctgattcatctcttctatcatcaccgactcgatgttgtgccagatggcggtgatatccgccattgtgatgccaagcaaccccattgcgaaccagcaggcggaaactacgcccagaccgctgctgatcactgcaagcccgacataatcagcccgacgaaaacggatgttgagcgtgctagccagaaacatcattacggcactaagaagttgccagcgaagaagaaccacgccagtggtgagggtagccatcaaacaattcctcggaaaagagctgatgccctggacagcgcggcgttgttcacgggaggcgtgatacactctggctatcgcggggcttgcagaacacaaaaatgaaacactctgtttgtttcatgaattttgtgaactatatcacaattggttgtttgttagccagattaggccgtaacttttattgccgtacagattatgtgttttttcagcggcattaagggtatatcttcccgccgcctctgcattcctgaaggtgattaatttttaagatcaatgaattatcgtcatcctggtgacgattaaaaaggtctcaattttatatcaggcaaaagtgctatttataccgtaagatttatctaaagacgtcggtagccagggtttcaccttgcaataaccgggtataaacaggcagggaattgatagcaatgagtcatcgtgcacgacaccaattactggcgtttccgggcattatctttttagttctctttcccatcattctgtcgctatggattgccttcttttgggcaaaatcagaagtgaataatcagctccgaacctttgctcagctggcgttggataaatctgagctggtcattcgtcaggcagatttagtgagcgatgcagctgaacgctatcaggggcaagtttgcactccagcccatcaaaagcgaatgttgaatattattcgtggctatctttatattaatgaattgatttatgctcgtgataaccattttttatgctcatcgctgatagcgtctgtaaatggctatacgattgcaccggccgattataagcgcgaacctaacgtttctatctattattaccgtgatacgccttttttctctggctataaaatgacctacatgcagcggggaaattatgtggcggttatcaaccctctcttctggagtgaagtgatgtctgatgatccgacattgcaatggggagtgtatgatacggtgacgaaaacctttttctcgttaagcaacgaggcctcggcagcaacgttttctccgctgattcatttgaatgatttaaccgtacaacgaaatggctatttatatgcgacagtttattcgacaaaacgcccaattgcagccattgttgcgacttcatatcaacgtcttataactcatttttataatcatcttatttttgcgttgcccgccggtattttggggagtcttgttctgctattactctggctacgtattcgacaaaactatttgtctcccaaacgcaaattgcaacgcgccctcgaaaaacatcaactttgcctttattaccagccaataatcgatatcaaaacagaaaaatgtatcggcgctgaagcgttgttacgttggcctggtgagcaggggcaagtaatgaatccggcagagtttattccgctggcagaaaaggaggggatgatcgaacaggtaactgattatgttattgataatgtcttccgtgatttgggcgcgtatctggcaacacataccgatcgctatgtttctattaacctgtcagcctccgattttcatacctcacggttgatagcgcgaaccaatcagaaaacagagcaacatgcggtgcgtccgcagcaaattaaatttgaagtgactgaacatgcatttcttgatgtcgacaaaatgacgccgattattctggctttccgcaaggccggttacgaagtggcaattgatgattttggtattggctactctaacttgcataaccttaaatcattgaatgtcgatattttgaaaatcgataaatcgtttgttgagacgctgaccacccacaaaaccagtcatttgattgcggaacacatcatcgagctggcgcacagcctgggattaaaaacgatcgctgaaggtgtcgaaactgaggcgcaggttaactggctgcgcaaacgcggcgtgcgctattgccagggatggttcttcgcgaaggcgatgccgccgcaggtgtttatgcaatggatggagcaattacccgcgcgggagttaacgcgcgggcaataaaactacaggcggtggcgataatcgctgggagtgcgatcaaactgccgacggaaaacgcgggagaaggtctgctgagagacataacccaggtccattgcgatatcaaaaatcggacgctcggtggtgcgcaactcaacggcggccagtaacagacggcgctggcgaatgtaatcgccaagcgtctgatgcgtcaccgtgcggaacatccgttgcaagtaccactttgaatagccagatttttttgcgacgacatcaatgttaagcggctggtcaatatgctcgtcaatccatgcgataagatcctgaataattttctgatgggacataaatctgcctcttttcagtgttcagttcgttaattcatctgttggggagtataattcctcaagttaacttgaggtaaagcgatttatggaaaagaaattaccccgcattaaagcgctgctaacccccggcgaagtggcgaaacgcagcggtgtggcggtatcggcgctgcatttctatgaaagcaaagggttgattaccagtatccgtaatagcggcaatcagcggcgatataaacgtgatgtgttgcgatatgtcgcaattatcaaaattgctcagcgtattggcattccgctcgcaaccattcgtgaagcgtttggcgtgttgccagaagggcatacgttaagtgcgaaagagtggaaacagctttcgtcccaatggcgagaagagttggatcggcgcattcataccttagtggcgctgcgtgacgaactggatggatgtattggttgtggctgcctttcgcgcagtgattgcccgttgcgtaacccgggcgaccgattaggagaagaaggtaccggcgcacgcttactggaagatgaacaaaactaaagcgccacaagggcgctttagtttgttttccggtctttgtctttctctctatcccgctggtacacaggagggtttcccccgacgtcaacacacctcattcgagcacgtggtggaggttccggttggtgttgatgctttaattgtatgttaccggcgtttcttcgccagtgtaaaagtacactttttagccgcaatatttttgtcatctcagacgattttttatcgcaatcctgaacggtatacggctcgataacgctgcaatcttgcgcatcgacgataacgtttgcgcatcaattgcctggtttttcatcgtcaagacaataaaagagaaaaaagcagcaaacttcggttgaaaaagccgctatgatcgccggataatcgtttgctttttttaccacccgttttgtatgcgcggagctaaacgtttgctttttttgcgacgcagcaaattgtcgcaaacctggagcaggaagataacgtttcgctggcaggggattgtccgccacgcatcttgacgaaaattaaactctcaggggatgttttcttatgtctacgccatcagcgcgtaccggcggttcactcgacgcctggtttaaaatttcacaacgtggaagcactgtccgtcaggaagtggttgccgggttaacaacgtttctggcgatggtctactcggttatcgtcgttccaggcatgctgggtaaagcgggcttcccgcctgcggcagttttcgttgcaacctgtctggttgccggactcggttctatcgtgatgggtctgtgggctaatctgccgttggcgattggttgcgccatctctctgacggcgtttaccgcattcagtctggtgctggggcaacatattagcgtacctgtcgcgctgggtgccgtgttcctgatgggtgtgctgtttacggtaatttctgccacgggtatccgtagctggattttgcgcaacttgccgcacggtgtggcgcacggcacggggattggtatcggtctgttcctgctgctgattgctgctaatggtgtcggtctggtgattaaaaacccacttgatggtctgcccgtcgcgctgggggatttcacgacctttccggtgatgatgtcgttggtggggctggcagtgattatcggcctggaaaaactgaaagtccctggtggcattctgctgaccattatcggtatctcaattgtcggtttgatcttcgatcctaacgtccatttctccggcgttttcgccatgccttcattgagcgatgaaaacggcaattcactgattggcagcctggacattatgggtgcgctgaatcctgtagtcctgccaagtgttctggcactggtgatgacggcagtatttgatgccaccggaactatccgtgccgtcgccggtcaggcgaacctgctggataaagatgggcagatcatcgacggcgggaaagcactgaccaccgactccatgagcagcgttttttctggcctcgtgggtgcagctccggcagcggtatacatcgagtctgcggcgggtacggcggcgggcggtaaaaccggtttgacggctatcaccgttggcgtgctgttcctgctgattctgttcctctctccgctctcttacctcgttccggggtacgcaacggctccggcgctgatgtacgttggcctgctgatgctgagcaacgtggcgaaaatcgactttgctgattttgttgatgcgatggcgggtctggttacggcggtattcatcgtgctgacctgtaacatcgtaacaggcatcatgattggcttcgcgactctggtgattggtcgtctggtttccggcgaatggcgcaagttgaacatcggtacggtcgttattgccgtggcgctggtgaccttctatgcgggtggctgggctatctaatcttacataggattctgaaaacgggtggcaatggctgcccgtttttattttctccgcacattgtgtgagcttttgcgatattctgaaaaaatgagaattcaggcataacgcctttctcagatcataaaaaacatcgcaaacagggaacgcatggaaatcttcttcaccatactgataatgaccctcgtggtctcgctgtccggggtggtcactcgtgtcatgccctttcagatcccgcttccgcttatgcaaatcgccatcggtgcgctactggcgtggccgacgtttggtttgcatgtggagtttgatcctgaactctttttagtcttgtttatcccgccgttgctgttcgctgatggctggaaaacgccgacccgtgaatttctcgaacatgggcgagagattttcggcctcgcgctggcgctggtggtggtcaccgtggtcggcattggcttccttatttactgggtggtgccgggcattccgctgatccccgcctttgcgctggctgcggtgctttctccgaccgatgctgtagcgctctccgggattgttggcgaggggcgcatcccgaaaaaaatcatgggcattttgcagggcgaagcgttgatgaatgacgcctccggcctggtgtcgttgaagtttgccgtggcagtggcgatggggacaatgatcttcaccgtcggcggtgcgacggtcgaatttatgaaagtggcaataggcggtattctcgccggttttgtggtgagctggctgtatggtcgctcgctgcgattcctcagccgctggggcggtgatgaacccgcgacgcagatcgttctgctgttcttgctgccattcgcttcttatctgattgcggaacatattggcgtttccggcatcctcgctgcggttgccgccgggatgaccatcacccgctccggtgtgatgcgccgtgcgccgctggcaatgcgcctgcgcgcaaacagcacctgggcgatgctggaatttgtctttaacggcatggtgttcctgctgttaggtctgcagttgccggggattctggagacgtcgctgatggcggcagaaatcgaccctaacgtcgaaatctggatgctgtttaccgatattattctgatatatgcggcgctgatgctggtccgtttcggctggctgtggacgatgaaaaagttcagcaaccgcttcctgaagaagaagccgatggagtttggttcgtggactacacgagaaatcctgatcgcgtctttcgccggggtgcgtggggcgatcactctggccggtgtgctctctatcccgcttctcttgccggatggtaacgtcttccctgcgcgctatgagttggtgttcctggcggctggcgtcattctcttctcattgtttgtcggcgtggtgatgttgcctattctgctacaacacatagaagtcgcggaccattcgcaacaattgaaagaggaacgtattgcacgagcggcaacggcagaagtggcgattgtggcgatccagaaaatggaggagcgtttggcggcggataccgaagagaatatcgataaccagctgctcacagaggttagttctcgcgtcattggtaacctgcgtcgtcgcgccgatggacgtaatgatgtagaaagttcaatcctggaagagaacctggagcgtcgcttccgtctggcggcattgcgttctgaacgtgctgaactgtaccacctgcgcgccacgcgggagatcagtaacgaaacgctgcaaaaattactgcacgatctcgatttgcttgaagcgttgctgattgaggaaaatcagtaatctgcatggttggcgggcgagcccgccaacccgacttactctggcgttaaccagtatccttcacaacagctcagccacgcgtgggcagagtgggaaaggtaaacgccctcacgccaaatcattcctaatttccagcttagttcgctttccagcggtagccattttaaggtgtttttatctaatcgctggcaaatgggttccggcaatatggctattccgacaccggcctgaaccatcgcggcgagaaaatcccattgcccgctgcgaactgcaattctcggcttaacgccatgttcatcgaataacttcatcaattgcttacttaaggcaaaatcttcgttatagataagtagaggatgttccgccaatgtctccggtgagacggcatcacattcaagccatttacctgaatgtggcgtcagtacacatagtggatgactaaacagcgataacgttgtcaggccgctttcttctactggcagggctgtcagtgccatatccagttcaccgttcatcaccgcttgttgtaccgtcagaccaccaaactccgaaattttcaattctacgccggggtaacgctggcgaaaaaggccaatcggcccggccatcaacatcccaaccatcggcgggattcccagccgcaaaacgccggttttaagctgattgatatcgctaagctcagcttccagttgccgaaactcagccagtaaagccagcccgcgctcaaatacgacgcgaccagtatcagtgagaagcagccgacgaccatcgcggatcaacaatatacagttcagctcatcttcgagattcttcagcatcttgctgatagttggttgggtgacaaacaacttctccgctgcgcgggtgaagctttgctggcgcacgacttcgacaaaataacgcagcgttctgatatccataactattccctttgactatacctgcaatgattttaattcatttcagtcaggggcgagcgctctctatacttaccattctgttttattttcaggatatcctctcatgcccgtggcgcttcgccgcattacccctgccgtagtgcaatctatccaggtattttttcaggttgtgctgtatgcaggtttatttatttttgcgcagtatctcgtctcctggctgcatttgccgctgcctgccaacctggtggggatgatcctgatgctggcgctgattgtttgtcgcattcttcctctgcaatgggttcgagccggggcgcgttggctattggccgaaatgttgctgttttttgtccctgccgtggtggctgtggtgaactatgcacaactattactggtggatggctggcgtatttttgctgtgatcgcgctgagtacggtgatggtgctgggcacgactgcctgggtagtggaaaaagtctatcgctatgaaatgcgcaggttaaaccgtggctaattttcagctaagtatactctgtctggcaattacgctagttatctattttcttaacaaacgcctttatcgccgctttcgtaaattgccattgatgcctctggtgctgacgcctacgctactggttatgctgctggtttttggcaatatttcctggcaaaactatattggcgaagcgcgctggttactatggctattaggtccggccaccatcgcctttgcggtaccagtgtatgacaatcgggcgatcattaagcgtcactggatgtcgttgacggcaggcgtactgacggcaacggtggtggcagtgaccagctcagtgtggctggcgcgattgtttaccctgccagatgagatccagcgtagcctggcggtgcgttcggtcactacgccatttgctttggcagcgagccagtcgctcggcggacagcctgatctggtggcgctgtttgtggtggtcaccggtgtgtttggcatggcgattggcgacgtgttgtttttacgtctctctattcgcgaagggatggcgaaaggtgctggattcggcgcggcatctcatggtgccgggactgcgcggtcgtatgaactgggtcaacaagaaggcgtagttgcaagcctggtcatgatgctttcaggtgtattgatggtattggtttcgccgctggtggccaggatgatgttctgaagaaattccccgatcaagcgaccggggaaggggagagattaatgcgcgcggccctgctcaacgccaaagccagtctgggaacggataaactgcgcacggaacagttcacgctcgcgcgcaccttccgctgaattatccgttgccgagaataaccagataccgaggaatgccacactgatagagaacagcgccgggtattcatacgggaagatggctttttcgtgaccgaggatctgtacccaaatagtcgggccgaggatcatcagcaccaccgcagtaatcagtcctaaccagccgcccagcattgcgccacgggtagtcagtttcgaccagtacatggaaagcagaatgatcgggaagttacagctcgccgcgatggcaaacgccagccccaccataaaggcgatgttctgattctcaaacagcacgccgaggataatggcaatcacaccgaggatcagtacggtgattttcgatacccgcagctcttcacgttcggtcgcaccttttttgaagacgttagcgtacaggtcgtgagacaccgccgatgcgcccgccagcgtcagacccgcaaccaccgcaagaatggtggcgaaagcaaccgctgaaataaagccgaggaacaggttgccgcccaccgcattggccaggtgaactgctgccatgttgttaccaccaatcagatggcccgccgcgtctttatattccggattcgcaccgaccagcatgatcgcgccaaagccgataataaaggtcaggatgtagaagtagcccataaatccggtggcgtagaacacgctcttacgtgcttcgcgggcatcgctgaccgtaaagaagcgcatcagaatatgcggcaagcccgccgtaccaaacatcagtcctagccccaaagagagcgcggagataggatctttcaccagcccgcccggcttcatgatgtcgacacctttcgggtgtaccgccatcgcttcgctgaacagattgttgaagctaaagccgacgtgtttcatcaccataaaggccataaagctggcaccgaacagcaacagcacggctttaataatttgtacccaggtggtcgccagcatgccgccgaacaggacgtacatcatcatcagcacgccgaccagcactaccgcaatgtgatagttaaggccaaacagcagctcgatcagtttacctgcgcccaccatctgggcgataaggtaaagcgccaccaccaccagagaaccacaggccgaaagaatacgaatcggcccttgtttcagacggtaagaggccacatcggcaaaggtgtagcgaccgaggttacgcagacgttcggcaatcaggaacaaaatgatcggccagcctaccaggaagcctagcgagtaaattaagccgtcatagccggaggtaaacaccagcgcggagatccccaagaatgaggcggcggacatatagtccccggcaatcgccagcccgttctgaaaaccggtgatattgccgcctgcggtgtagtagtcattacgcgaacgtacgcgttttgacgcccagtaggtaatgccgagcgtaaacacgacgaaaatcaggaacataataatcgcctgccagttcgttggctgacgctctacggccccgctaatagcatccgcggcgttagctgcgaaagggagtgtggcggcaagcgccgtcagaactcttttcatgatgcttgtacctcatgcaggacttcgttattaagacggtcgaattcgccgttcgcccgccagatgtagataccagtgagaacaaaggagatcacaattaccccgacaccgactggaataccgcgtgtgacgctggtgttcggattcagcggggtgcccagccagccgggcgcgaaggcgatcagtaaaataaagccgatataaactgccagcataataatcgacaggatggtggcaaaccgttgccgtttttcgactaactccctgaaatgcgcattgtcttctatccgctgataaatcgtaccattcatcacagattctccagaggtaatgtagggattgttttaattcccgctcccttatgggagaaggttaacgcttgggtaacccttgccgaatgtaggccggataaggcgttatacgccgcatccggcaatcaatgcctgatgcgacgctgtcgcgtcttatcaggcctacaaatcgtttccgacttgttgcccggagcgcatccggcaattgtgggttacgatggcatcgcgatggcctgcttctcttcaagcagcttctcgactacgccaggatcggcaagcgtcgaggtatcgcccaggttgctggtatcgcccgccgcaattttgcgcagaatacggcgcataattttgccggagcgggttttaggcagggagtcggtccagtgcagcacgtctggcgtcgccagcgggccaatctctttacgcacccagttgcggacttctgcgtacagttctggtgacggttcctccccgtgattaagcgtgacgtaggcgtagatcgcctgacctttaatattgtgcggaataccgaccacagcggcttcggcaattttcggatgcgccaccagcgccgactcaatctctgccgtccccaggcggtgaccggagacgttcagcacgtcgtccacgcgcccggtgatccagtaatagccatcttcatcgcgacgcgcgccgtcgccgctgaaatacatatttttgaaggtggagaagtaggtctgctcaaaacgttcgtgatcgccaaacagcgtacgcgcctgacccggccaggagtcggtgatcaccagactgccttcggtggccccctccagcgggttaccttcgttatcgaccagcgccggttgcacgccgaagaacggacgtgttgccgaaccggctttcagctcggtagcgccaggcagtggcgtgatcatgaaaccgccagtttcggtctgccaccaggtgtcgaccaccgggcatttctcgttgccgatcttcttccagtaccactcccacgcttccgggttaattggctcgcccacggaaccgagaatgcgcagcgacgaacggtcggtgccttcgatcgctttatcgccttccgccatcagcgcgcgaatcgccgtgggcgcggtatagagaatattgacctgatgcttgtccaccacctgcgccatacgggcaggcgtcggccagttcggtacgccttcaaacatcagcgtggtcgcgccgcaggccagcgggccatacagcaaataactgtgtccggtaacccagcccacatcggcggtgcaccagtagatatcgcccggatgataatcaaagacatatttaaaggtcagcgccgcgtacaccagataaccgccggtagtgtgcagcacgccttttggcttaccggtagaaccggaggtatagagaataaacagcggatcttcggcgttcatctcttccgcctggtgctgagcgctggcttgctcaaccaggtcgtgccaccacaggtcgcgcccttcctgccagtcaatttttccaccagtacgcttcagtaccaccacatgctctacgctggtgacgttcgggtttttcagcgcgtcatcaacgtttttcttcagcggaatactacgcccggcacgcacaccttcgtcggaagtgatcaccagtcgtgaactggagtcgataatgcgtccggcaacggcttccggcgagaagccgccgaaaatcaccgaatgtaccgcgccaatgcgggcgcaggccagcatcgcgaccgcggcttccggtaccatcggcatataaatcgcaactacgtcaccttttttaatgcccagttcgagcagggtattggcgaagcggcagacgtcgcggtgcagttctttatagctaatatgtttgctctggctggcgtcgtcgccttcccagatgatggcggtacgatcgccgttttcttgcagatggcggtcaaggcagtttgccgccagattcagcgtgccgtcctcgtaccatttaatggacacattaccgggggcaaaggaggtgtttttcaccttctggtacggtgtgatccagtcgagaatttttccctgttcgccccagaaggtatctggtgcgttaatagattgttgatacatcgcctcgtactgctgagggtttatcaggcaacggtctgcgatgttggcaggaatggtgtgtttgtgaatttgactcatgcttttgttctccttgcaagatgttaataatatgtggcatgagcgttaaatgtaggggtattggcagttttgtttagtatttgggcgacagatcacgcaaaagtagaattgtgcaaataaacggcagggtaatttttgaaggtcagcaacaaaagttgattaattctttgaggaacatgcagttatgcatgctgttgaaaaagaggaagatactaactaactctaaagtggtattttacatgcacttacaattgattaaagacaacattcacagtgtggttatttgttacacataggggcgagcaatgtcatgacagtgtaggtgcggttactgtcgtgaaaaacaataaaaaccgccattgcaacaatggcgcaattcggatgaagccctatgacaaggataaaaataaacgcacgccgtatcttcagcttattgattccttttttctttttcacttctgttcacgctgaacaaacggctgctcccgcaacacctgtaactgtggaagcgaagaataaaacctttgccccgcagcatcccgatcaatatctctcctggaaagctacctcggaacagtcagagcgtgttgacgccctggcggaagatccacggctggtgatcctgtgggcagggtatcccttctcgcgcgattacaacaagccgcgtggacatgcctttgctgtgaccgatgtgcgtgaaaccctgcgtaccggtgcgccgaaaaacgctgaagatggtccgctaccgatggcgtgctggagttgtaaaagcccggatgtggcgcgtctgatccagaaagacggcgaagatggctacttccacggaaaatgggcgcgcggcggcccggaaatcgtcaacaacttaggttgtgccgattgccataacaccgcctcaccagagttcgccaaaggcaaaccggagttaaccctttcccgtccgtatgcggctcgcgcgatggaagccattggtaaaccttttgagaaagccggacgtttcgaccagcaatcgatggtttgcggtcagtgccatgtggagtattacttcgacggcaaaaacaaagcggttaaattcccgtgggatgacggcatgaaagtcgaaaatatggagcagtattacgacaaaattgccttctctgactggactaactccctgtcgaaaacgccaatgctgaaagcgcagcacccggaatatgaaacctggacagcgggcattcacggcaaaaacaacgtgacctgtatcgattgccatatgccaaaagtgcagaacgccgaaggcaaactctacaccgaccataaaattggtaatccgtttgataacttcgcccagacttgtgcgaactgccatacccaggacaaagctgccttgcaaaaagtggtcgcggaacgtaagcagtcgattaacgacctgaaaatcaaggttgaagatcaactggttcacgctcacttcgaagcgaaagcggcgctggatgcaggcgcaacggaagccgaaatgaagccgattcaggacgatatccgtcatgcccagtggcgttgggatttggcgatcgcttcccacggcattcatatgcacgcaccggaagaaggtctgaggatgctcggtacggcgatggataaagcggcggatgcacgcaccaaactggcgcgcctgctggcgaccaaaggcataacccatgaaatccagatcccggatatctcgaccaaagagaaagcccagcaggccattggcctgaacatggagcaaatcaaggccgagaagcaggacttcatcaaaacggtgatcccgcagtgggaagagcaggcacgtaaaaacggtctgttaagccaataaccccgttccgcctcgcaaggggcggaaaacacaatggagtgaatatgagcgtattacgttcgttattaactgccggggtgctggcgtcgggcctgttgtggagcctgaacggaattaccgctacccctgcggcgcaggcatctgatgatcgctacgaagttacccagcagcgtaacccggatgccgcctgtctggactgtcataagccagataccgaaggtatgcatggcaaacatgcttccgttatcaacccgaataacaaactgccggtcacctgcaccaactgccacggtcagccatcaccgcaacaccgcgaaggggtgaaagatgtgatgcgctttaacgagccgatgtacaaggttggagagcagaacagcgtctgtatgtcctgccatctgccggaacagttgcaaaaagcgttctggccgcacgatgtccacgtaaccaaagtggcgtgcgccagctgccattccctgcatccacagcaagatacgatgcagacgttaagtgacaaaggacggattaagatttgcgtcgattgccacagcgatcagcgcaccaatccgaactttaacccggcgtctgttccgttgcttaaggagcagccatgacctggtcacgtcgccagtttctcaccggcgtcggtgtgctggccgccgtcagcggcaccgcaggacgcgtggtggcgaaaacgttgaatatcaatggtgtgcgttacggcatggtgcatgacgagtcgttatgcatcggctgtaccgcctgtatggatgcttgtcgggaagtgaacaaggtgccggaaggcgtctcgcgcctgacgattattcgtagcgagccgcagggcgaatttcctgatgtgaaatatcgcttcttccgtaagtcttgccagcactgcgatcatgcgccgtgcgttgatgtctgcccgaccggtgcgtcttttcgcgacgctgccagtgggattgtcgatgttaatccggatctctgcgtcggttgtcagtactgcatcgccgcctgtccgtaccgcgtgcgctttatccatccggtcacgaagacggcggacaaatgcgatttctgccgtaagacccatttgcaggccggtaagctgcccgcgtgcgttgaggcttgcccgacgaaggcgctgacgtttggcaatctggacgatcccagcagtgagatttcgcaactgctgcgccagaagcccacttaccgctacaagctggcgctgggaaccaaaccgaagctgtaccgcgtaccgtttaaatacggggaggtgagccaatgacgcagacttccgcatttcattttgaatcgctggtgtgggactggccgattgccatctacctgtttttgattggtatttctgccggtctggtgacgctggccgtactgttacgtcgcttctaccctcaggcaggcggtgcagacagtacgttgctgcgcaccacgctgattgtcgggccgggcgcggtgatcctcggtctgttgatcctcgtcttccacctgacaagaccgtggaccttctggaagctgatgttccactacagttttatctcggtgatgtcgatgggggtgatgctgtttcagctctacatggtggtgctggtgctgtggctggcgaaaatctttgaacatgatttgcttgccctgcaacaacgctggttgccgaagctggggatcgtgcaaaaggttctgagcctgctgacgcccgttcatcgaggactggaaacattgatgctggtgctggcggcgctgctgggggcttataccggctttctgctgtcggcgctgaaatcgtatccgttcctcaataacccgatcctgccggtgctgttcctcttctccggcatctcgtccggtgcggcggtggcgctgatcgccatggcgatacgccaacgcagtaacccgcattccacggaagcgcactttgtacaccgtatggaaatccccgtggtatggggtgaaatcttcttgctggtggcgttttttgtcggtctggcgctgggcgatgacggtaaagtgcgtgcgctggtggcggcattgggcggcggtttctggacgtggtggttctggcttggtgtcgccgggctggggctgattgtgccaatgttgctcaaaccgtgggtcaatcgcagttccggcattcctgccgtgctggctgcgtgtggggccagcctggtcggcgtgttgatgctgcgctttttcattctctacgccgggcagttaacggtggcgtaagccagaacagaggtggtttctggacgtattccttcctgaagtcggttttctggcgttgttgttaagtctcggggtcaacgtgttgaccccgttgacggccttcgcgggagtgcggttgcgctggcctgccatgatgcgactcacttgcatcggcattctggcgcagttcgcgctcctgctgctcgcctttggcgtactgacgtattgttttctcatcagcgatttctcggtcatttatgtcgcccaacatagctatagcctgctgtcgtgggaactcaaactggcggcggtgtggggcggtcatgaaggttcgctgctgctttgggtgctgctgctttccgcctggagcgcgctgtttgcctggcattatcgacagcaaaccgatccgctatttccgctcacgttaacggttttatcgctgatacttgccgcactgctgctgtttgttgtcggatggtccgatccttttgtgaggatatttccgcccgcaatagaagggcgcgatctcaacccaatgctgcaacatcccggtcttatctttcatccaccgctgctttatctcggctacggcggtttgatggtggcggcgagcgtggcgctggcgagtttactgcgcggcgagtttgatggtacctgcgcccgaatttgctggcgttgggcactacctggctggagtgcattaaccgcagggatcattctcggttcctggtgggcttattgcgaactgggctggggcggttggtggttttgggatccggttgaaaacgcgtcgttattaccctggctttcatctactgcgttgctacacagtttgtctttgacacgccagcgggggattttccgccactggtcgctgttgctggcgatagtaactctgatgctgtcgctgctgggcaccttaattgtccgttctggcattctggtttcggttcatgcgttcgcgctggataacgtccgcgccgtgccgttgttcagcctgtttgcactgattagccttgcgtctctggctctgtatggctggcgagcgcgggacggtggcccggcggtgcgtttttcggggttatcgcgggaaatgttaatcctcgctacgctgttgctgttttgcgcagtgctactgatcgtgctggtgggaacgctttatccgatgatttacggcctgctgggctggggacgcctctccgttggcgcgccgtattttaaccgcgcaacgttgccgtttgctctgttgatgctggtggtgattgtgctggcgacgtttgtctctggcaaacgtgctcagcttccggcgctgctggcgcatgcgggcgtgctgttatttgccgcggggatcgtggtttccagcgtcagccgtcaggagatcagcctgaatttacagccgggtcagcaggtgacgctggcaggatacaccttccgttttgagcgcctcgatctgcaagccaaaggcaattacaccagcgaaaaagcgatagtggcactgtttgaccatcagcaacgcattggtgaattaacgccggagcggcgtttttacgaagcacgtcgtcagcaaatgatggaaccgtcaattcgctggaatggcatccatgactggtatgcggtcatgggcgagaaaaccggagcggatcgttacgcttttcgtttgtatgtacaaagcggtgtgcgctggatctgggggggaggattgttgatgatttcgggcgcattgttaagcggatggcggggaaggaagcgcgatgaataaagggcttctcacgctactgctgttatttacctgttttgcgcgcgctcaggttgtagacacctggcaattcgccaatccgcaacaacaggaacaggcgttaaatattgccagccagttacgttgtccgcagtgccagaatcagaacttactggaatccaatgcgccggtggcagtcagtatgcgccatcaggtttacaccatggtggaagaggggaaaagtgaagtcgaaatcattggctggatgaccgaacgctacggagattttgttcgctataacccaccgttaacgggtcagacgctggtgttgtgggcgctgccagtagtgttgttactgctgatggcactgatcctctggcgagtgagggcgaagcgatgaaacagccccaaataccggtgaaaatgctgacaacactcacgatttttatggtatttctctgtgtcggcagttatctgttaagtccaaaatggcaggcggtacgtgcggagtatcagcgtcagcgcgatccgctgcatcagtttgccagccagcaaaccccggaagcgcagcttcaggcattgcaggataaaatccgtgctaatccacaaaacagcgaacagtgggcgttactgggcgagtattatctgtggcaaaacgattacagcaattcgctgctggcgtaccgtcaggcgttgcaactacgtggtgagaacgctgaactgtatgcggcgctggcgacggtgctgtattaccaggccagccaacatatgaccgtccaggctcgcgcaatgatcgacaaagccctcgcgctggactctaacgaaatcaccgctctgatgctgctggcttccgatgcgtttatgcaggcgaattacgcgcaagccatcgaactatggcaaaaagtgatggatctcaactcaccccggatcaaccggacacagctggtcgagtcgattaatatggcgaaattgttgcagcggagatcagattaatcatctggtgatgaagattatgttattgagctgcataaaaaataatcgaatgaacatataatcaaaaataatcactaatcagtattattgcagattaaacaaataaaaatccttctataacaaatggttattcattaatcctgccataaactcgcgttattatgcattaatgcagcgaaaagctctgttgttaaagggttgcgcaacataccgcgcaaatgatactgatcataagcgttaaaaaaatctacaaaccaacgcaacacaattcatgccctggcagtatgtcacgttctcgcgtttctgaacggggaacggcgctccattgaggaagttattctgatgaaaaatataaaattcagcctggcctggcagattctgtttgctatggtgctgggcattctcctgggaagctacctgcactaccatagcgacagccgcgactggctggtcgtcaatttgctctctccggcgggtgatatcttcatccatctgatcaaaatgattgttgtgccgattgtgatctccacactggtggtgggtatcgcgggtgttggtgatgccaaacagctcgggcgtattggtgcgaaaaccattatctacttcgaggtgatcaccaccgtcgccatcattttggggatcactctggcgaacgtcttccagcccggtgccggggtggatatgtcgcagctggcgaccgtcgatatctcgaaatatcagagcactacggaagcggtacaaagcagttcccacggcattatgggcacgattttgtcgctggtgccgacgaacatcgtggcgtcgatggcgaaaggcgaaatgctgccgatcatcttcttctcggtgctgtttggtctggggctttcatccctgcccgcgtcgcatcgtgaaccgctggtgaccgttttccgctccatctctgaaaccatgtttaaagtgactcacatggtgatgcgttatgcgccggtgggtgtgtttgcgctgattgcggtgacggtggctaactttggtttctcgtctctgtggccactggcgaaactggtgctgctggtgcatttcgccattctgttcttcgcgctggtagtgctgggaattgtggcgcgcctgtgcgggttaagcgtctggatcctgattcgtattctgaaagatgagctgattctggcgtactccactgccagctctgaaagcgtgctgccgcgaattattgagaagatggaagcctacggagcaccggcgtcgatcaccagtttcgtggtgccgaccggttactcttttaaccttgatggttcgacgctgtatcaaagtattgccgctattttcatcgctcagctgtatggcattgacctgtccatctggcaggaaatcattctggtgctgacgctgatggtgacctcgaaagggattgctggcgtgccgggcgtgtcgtttgtggtgttgctggcaacgctgggtagcgtaggtattccgctggaaggtctggcgtttattgccggtgttgaccgtatcctcgatatggcgcgtactgcgctgaacgtggtgggtaatgcgctggcggtgctggtgattgccaagtgggaacacaaatttgaccgtaagaaagcgctggcttatgagcgtgaagtgctgggcaaatttgataaaacggcggatcagtaattgaagattgccggggggatatccacccggcaatgtgtggatgcctgactgagtaatagcctgatgtagcgtgatttttgtaggtcggataaggcgtttacgccgcatccgacatcaacgcctgatgcgacgcttgccgcgtcttatcaggcctacgtcagacagcgcaatagcctgatgtagcgtgattttgtaggtcggataaggcgtttacgccgcatccgacatcaacgcctgatgcgacgcttgccgcgtcttatcaggcctacgtcagacagcgcaatagcctgatgtagcgtgattttgtaggtcggataaggcgtttacgccgcatccgacatcaacgcctgatgcgacgcttaacgcgtcttatcaggcctacgccagacagcgtaatagcctgatgtagcgtggtttttgtaggtcggataaggcgtttacgccgcatccgacatcaacgcctgatgcgacgcttgccgcgtcttatcaggcctacgccagacagcgcaatagcctgatgtagcgtgattttgtaggtcggataaggcgtttacgccgcatccggcatcaatgtctgatgcgacggttgccgcgtcttatcaggcctacgccagacagcgcaatagcctgatttggcgtgatttttgtaggtcggataaggcgtttacgccgcatccgacatcaatgcctgatgcgacgtttgctgcgcctaccttaaccgttagttaatttttcaaactcttcacaaccggtatcaaacccttccatacagctcaggttcaaccagtgcagcgccttttgtttgttcttctcgataaaaccctcttcaccgtttaagaacatcattcccgcccagtattcggaataaccggttcgggaaatcgcagagctgcgtttgaaataccaggttgctttgtcatcgtcggccttaatgcccacgccgttggcgtaaatcaaaccaagcagcatttgggcatcgacggcagagtcgttctccagatcttccgaggcgttttctaacagcgaaatcgcctttggataatccggtttacccgcttgcgtatttaccagaatatgcgccagcgttacttcaccttctttactgcccgcttgcgctgctttctcggcaagcacttttgcttgtggatagtccagactgaccggattggtgattttgatctgcgccaacagcgcgcaggcatcggcatcaccgctgtcggcggctttctgtgcccaatattcggctttgctcaaatcgccggagctaaaccagctgtcggcaagaaaatattgtgcgcgtcggtctccggcctctgctgcctttaaatactggctgccaggctcggagtcgttcgcgtgggcaaagaatgtcaaaaacaacatcaaagtgataatttttttcattttgataatgaagtttggtaggggagagacagtataaagtgttcgggtggacaaaaaaacaactgtaaaaagacctgaaagcagaatgaattaatgcaatgtcaggttttttaatccatccgatgttcccccttttccatggcgtcgcgatcaaaaaatcgctgaatttttccctcggacatcaatgccgctcgatcagacatatgcgcgatgatatcggcatcgtgactgaccagcagatatgtcatttggtgttccagcttaagttgattcaacaaattaaggatttccgcttgtaccgacatatccaacgccgaggtgggttcatccagcagaagaagttgtggtcgtaacaacagggcgcgagcaataaccacacgttgccgttgaccaccggaaagctggtgtgggtagcgacgagcggcgtcgaaaggcaagccaacctgttccagtgcagtctggacgcgtttttctatttctctttcgccacgaattttgagtggttcagccagcgttcgccacagagtatgattgggatgcaacgaggcatagggatcctgaaacaccatttgcacattgcggcggagatcgccctgaaaacgcattccgggtttgatggtgtgcccaaacagtgacacctgaccgtgccagtcgcgctgtaatccagcaattacgcgcaaaatcgtggattttccgcagcctgattcgccaattaaactaaatgtctctccggcattaaccgaaaaactggcggcagaaactgcggttttctcagcaaaagtcacctgtaagtgattaatttcaacaatcgtcatggtatttctccggcgtcattgccgtcctgtccagcgtcggcagcatctgcccgtaagtttgtgcatttgggcggcaagtccacagtgtgcgcgtgtaaggatgcgttgctgtaggtagcgcagcagcgtgcatttcatccaacttatttccctgatacatcaccagcacccgatggcaaaattgggcaactaatggcaggtcgtgactgatcagcaacattgccatctgacgttgttcacactgggtaaccagcagttccagaatctgattacgcaggcgcacatccagtgctgatgttggctcatcggcaatcaatacccggggatcgttgatgagcgcaattgcaatcatcactcgctgccccatgccgccagaaagttcacgaggatagctttgcagtactcgcgtattgaggccgacagcctgaattgcggtgtttattttctcttctttctcgcggcggttcagacgttgatggagcgtaagtgcctcttccagttgcgcttttactgtctttactggattaagcgcgtaacgcggatcttgcaataccatcgcgatatcgttaccgcgcaactgttgccatccacgcgcgttaagggtgagtgcatcacgccccagaatgttaagtgtgtccgcggttactacacccggtttacgcaccagccccatcagggcgcgggcggtcatggacttacctgaacccgactcaccgaccagcgccagacgttcattgcctaatgtaaaactgacattgttgacgacccgggactccggataatcgacgcagagattattgatactaagacgtgagtcagtcatgttgaggctccagaacatcgcgcaagccatcacccagcagattaaaggccagactggcaattaagataattgcgccgggagcggcggcaatccaccattgatcaaaaatgacctgcataccgtcggcgatcatggctccccattccgccattggcgggcgagcaccaagcccaagaaaacccaggccagcagccgccagaatgatacccgctaaatccagcgccagacggacaatggcagatggcaggcacaatggtaaaatatgaccagccagcagacgcctgccgcggatgcccatcatttctgcggcggcaagataatcactgtgtcgcagacgttggatctcactccgtgcctgacgcgcataagcaggccaggtggttaatgccagggccagtgcgccgttaaccagccccggccccagcatggcaacaaaagcaaaagccagaattaaacgcggcattgacattactacgtcagtaaaacgcatcagcacgcgttccagccagccgccgtagtacccggctaaaatgccaatcagcagaccgaccgggagtgtaatgattgtcaccaatgccaccagccccagtgccgggcggctgccgtagattaaacgtgaaagtaggtctcgcccgtaactgtcagtgccgagccagtgctgacgactcggtgcttgtaaccgcgccgccgcatcctgccagttaggatcgtgaggtgccagccacggcgcgaagagcgcaattagcatcaataacaggataattatcaacccgcaaaacgcggcgggtgaatggcgtaaacggcgtaaaaagagaaacatcggcatcagcgtaacctcggatcggtcagccggaccagcaggtcggttaagttatttatcaacacaaagcagacgccaatcagcagcgttcctcccatgattgctgtggtatcacccgcgaagagcgctgtagtgaggtagcgcccaatacctggccatgaaaagacggtttctgtcagtaccgcgccttccagcattgatgtataggcgagggcgataacggtgagcaaggtgccgcgaatgttgggtaaaacatgacgtagcaaaattgtcatctcgctggcccctttggcgcgcgccagcagaatatattctttattcatttcgccaagacaggcggaacgagtcaggcgcgtaatactggcgagcgagaagtacgccagtaataaaaccggaagtatcaaatggttgattgcattggtaaatgcctcgcgatcgccagaaagccacgtatcaatcagcgcaaatccgctgcggggttctatggtgaattgataaatatcatccagcctgcccggcccggcactccattgcagtctggcgtagaacagcgccagcatcagcagaccaagccaaaaaacagggacggaatttcccagtagagttaatgttcgcacggtgaaatccagcggagaaccgacataacgggcgcaaagtacacccgcaatgacgccgacaacagcaccgacaataagcgccaacgttgccagttcaatggtcgccgggaatactgatagcaagtcctggagtaccggttgcccggtggagctggcgatgcccagatcgccgtgtgccagattcatcaggtaatgccagaactggacggctaacggctgatccaatcctaactggtggcgtacctgatcataggtggactggctggcgtgatcgccaacgatttgtagtacgcgatcgaccggtgagagagccgaaagcgcaaaggtaatcagcagcaggccgagtagcgtcagagcaacggtaaacagcccttgcaacagcgcgagcagagggcgcttgcctcgccatctcgcgcgagtggaaaaaacgacagacatgatctttccatacagtgataaatcagcggctggcctgcaatacaggccagccctggtaccgcgcccggtaacagggctggacgcgagttgcatacagggttatttggttacctgatcaaaccagaccatatcggcattcaacccttgttgatacccctgcacattatcacgcatgacaatttgcgttttgccttgatcaataaagacatacggggaactacgttgtagttcttgttgcattttcttatacaaatcaagacgtttagcgctatcaggttcagcgatggccgccagcgtttctttgttcagttccgggattttccagccgtttaacccggcaacggtgctggatttgccatcgttataggcgaaagagctggcgttggaatgtgcgtcaaaataatcaggcaaccacatacgaatggccccctgatgctggtgggcgcgaacgcgagagtagacctgactccctgcggctggcagcaaatcaacttttacaccgccctgagcaaagctggcctgaattgactgcgcgatggtaataaatggcggtttattttcgacatcaagcgtgaagtgcgggtctttgattccggctttagcgaggatctcttttgctttggctggattaaaggtaaacggtgtttcttccagtgctccaggaaagcccacgggcaggaaactttgatgggtaaaatattgtccttttaagagatttttggtgatgccgtcgtaatcgaccaaccagcgagcggcctcccagaacgcaggattactcatcagcgggttatccttgttaccggtattgaaggccaggtagttctgttcggcggaggcaatgctcatcacttttacgccaggtttaccctgtaatgcatcgatttgatcggctcccagatcacgagccatatcagcatcaccttgttggatcagcaggcgacgcgttgccggatcgggaacatttttgatgatgacgtttttcagtttcggggcgccggttggtgagctggcgttggcttccatcacgatggcctgatgcggttggtaagtacgcattttaaacgcgccgctgccagcggaatgcatcttcagccattcattaccaaagtcgttatttttggcgtttggcgcaaccagcttctcgtcaacaattgaggcgattggtgtggagagaatattcagtgccagcgccgggctgacgtcggcactccattgtacctggacggtatggtcatcgattttcttcaactggctggcgatattttccggctgccatcccagcacattgagaataaacgcaccggatttattcagtgtgacagcccggacataagagtaaatcacatcttccgggcgtaccggattaccagaggcaaatttcgcatcgcttttcagttttatggttagcgttttggctgcggggtcagcctgccaactttccgccagaatcggagtgattttcgtcggatcattacggtccggttgtactacgcgttgatacagacttggtacagtctgaatacttgagagttcattagcttctgccgggtccagactcacaatatcatccagtccctgggctacaaccaacgtattcggcggtgtagcggcaacggttgtggcggaaattgtgcttaaaaccagtaaaggtaatagttttttaatcatatgcttcccaatccctgaaattactttgaggttattaatatgctatcagacgggggttcgctgcattaatcgcgccaaaatatcccgttaatagaacgagttaaacggtcgatgatttctcaccttaccgaaattttgtttatcaaatgtaaagtattattacgttaggccgcgatgagaattgagtaaagataattctcatttgcaatcgtgactggaatagaagaacaaccgagaagacgtcgctaataaccaggatgggctggtttgactgcgcaggtatgtataaaaaaatccggaaacagagagtcgtttccggattgatacaaaggcgttgggtaatatcgccgcttttaacgtgagtttaagcggtattacgccagtgccgcttcgcgcaggcgagttttcaacttgttgtactcgtcaatcacgtactgctcggcggcgcgctgatcggcgatcggctcgacgcgcacggcgcagtatttgtattccggcgttttcgtaatcgggcttaagttttcggtcaccagctcgttacaggcaccaatccaccactggtaggtcatgtaaatcgcccctttgttcggacgatcgctgacctgcgcacgggtgataattttgcctttacgcgagtgcacccaaaccaatgcctcatcttcaatacccagacgtttggcgtcttcggtattgatttgtgcgtagccaggttcatcagccagcgccgccagtgccgcacagttaccggtcatcgaacggcaagagtagtgaccaacttcacgcaccgttgacagtaccatcgggtattcgtcggtgagtttgtcgattggcgctacccagtcgcaggtgaagaactgcgccagaccgttcggggtatcaaacttctctttaaacagataagaagtcccctgatcggcatctgaagtatcgcggcaaggccactgaatgaagcccagttcgcccattttctcgtaagtcgcaccgtagaaatccgggcacagatgacgcaactcgtcccagatctcctgggtgttgttgtagtgcatcggataacccatacgagtggcaatttcactgatgatttgccagtccgttttcagatcccacttcggctcaaccgccttgaagaaacgctggaagccacggtcagccgcagtaaacacgccttcatgctcgccccacgacgttgacggtaaaatgacatccgccgccgacgcggttttggtcataaagatgtcctgaacgataaccagttccagatcttcaaaggctttacgtactgccgacagttccgcgtcagtttgcagcggatcttcgcccataatgtacgccgctctcacttcaccatgcgccacgcggtgcggcagctcgctgatgcgatagccggtatgagcaggcaggctttccacgccccaggctttggcgaatttctcgcggttagccggatctttcacgtactgatagcccggatacgtatccggcagcgcgcccatatcgcaggcaccctgcacgttgttctgaccacgaaccgggtttacacccgcatgtggcttaccgaggttaccggtcagcatcgcgaggctggtcagagaacgcacggtttccacgccctgatagaactgggttacccccatgccccacaggatggcggcgctttctgcctgggcatacatccgcgccgcctgacgaatctcactggcgctgacgccggtgatatcttcaaccgactccggcgtgtagccttcaacgattttacgatactcttcaaagccttctgtacgggaagcgacgaacgctttgtcgtacagattttcttcaataatgacatggcccatcgcattcaacagcgcgatgttcgagccgtttttcaatgcaatgtgcatgtcagcaatgcgcgcggtttcaattttacgcggatcgcagacgataattttcgccccgttacgtttagcgttaattacgtgattcgccacgattgggtgggaatccgccgggttatacccgaaaacgaacactaaatcggtattatcaatttcgttaatagcattgctcattgcgccattaccgaccgattggtgcagacctgcaaccgatgggccgtgtcagacacgagcgcagcagtcaacgttattggtaccaataacggcgcgcgcaaatttttgcattacatagttggtttcgttacccgtaccgcgcgaggagccggtcgtctggatggcatccggaccgtacttctctttgatggcgctcaggcgctcggcaacgtaattcagtgcctcatcccaggaaacaggttcgagtttgccgccacgctggcgacggatcatgggggttttcaggcgcggggtcaggatctgggtatcgttaatgaagtcccagccataataacccttcagacacagggtaccctggttggttttcccctgcgctgcctccgcccggacgattttgccgttatcgacgaccaggttgattttgcaacctgatgcgcaataggggcaaaccgtgacgacttttttcatcggtctcgctccagttaatcaaatcacgcatacgcgctctcgactacagtatgcatcttttatgccacattttatttggggtcattccctgatattacgggcactatttattcaaaactctgacgaaaaacaggctgtcgtcagttttgacgtgacgaaacgaaataccgcgtgacagccatcacgcggtagacattttattttttctcgacgatgggagctgcctgatacccgccgcccagcgatttcatcaactgaatgctttggatcacccggcggctgtccagcatcagtaatgacatctcttcggcaagcactggcaaccgggcttcggtggcctgtaagcggctggttaagccgcgctgataggcggcctcggctgcgcgctgggtgaagcgcgttgcttctacgcgttcagcctgcatctctcgctcgtcgttgagcgtttgcagacgtgtgccgttgacggcaacgtcacgcaccgcgttcagtactgactggttgtaacgttcaatcatcatgttgctggcggcgcgagtgccttcgagattggcattcaaccgtccaccgtcaaacagcggcaatttcagacccgggatgaagttgaactggcgactggtttttttgaataaggtatccaggtggatggagtccagaccgaaaaacgctttgatatcaaagctcgggtagaacagcgcccgcgcggaatccacctgatctaatgacgcctgaacataccagcgcatggcttgcagatccgggcgtctggcgagcaactcataagagagcgttgccggaatgccggtctgtactcgtggtaatgccaccggtttgatctccggcatatcgctggctcccgcgccaatcaatgcacgcagagattctcgcgtttcagtgatttgccctttgacggcagcaatttgtttatcgaccgccagaatctgtgcccgcgcgccgtggaaaggcacttgcgcttccagaccgtgcgccactttactctggtgcgctttcaccgcgtaatcaatcacatcgcgagtttgttctaacagatcgagcatctgatagctggcctgcatactgtaataaagctgcgctacgcccgtggtcagcgatagctctactgctacggtttctgccagcgcggcattatgcgcgccaatggcggcagcaaccgctgagcgatgcacaccccacaaatcgagatccagtccggcaaacaaaccgactgtggcttccgtatagtacggcccgtccatacccagtgctggcgcatccatcgcataagggcttaaaaagccgttcgccgagacgcgttggcggttgagcatccctaacgctgcgacctgtaattgtgaaccggcatctaacaaatcggcctgggactgcgctttttcttcccgcagtttcgcttcggcgagggggtgtgaaccacttagcgtccgttggatcagcgaatccagctgcgggtcattgagttgtttccaccactgcgcctgcggccagccggagctggcaagatgaatatcatcggccagtttgatttgctccggtttgagctgttgatgaggcgcagaatccttacgtaccagggcacagccggaaatcagcgtcgtgctgccgagaatgctgcacaacagcagacgtgaaagttgacgattgatcattgcgtggctccttgtgcctgttccgtggcgggcgttaatgccggggctgtccagtctggcaagcgggcgaaaagctggcagacgtgttgctcctgttttaataaggtgggcagaatggcctgcgaggcggatgtctcttctaacgttatttgaggagaatgactgagtgcggtagccacaccggcagcgtatttctccagggcgtcggcaaactgacctgctctgtccggctgtagtgcgttatccagcgcctgcgccgagttccaggtggcatcccaggcgtgaagaatatcgcggccctgacgaataaccgtttgcgaacgttcaatcagtaatgcgcgttcttcgctgtccagttgacgctccagcaccacgcgttggcacatctcttcacaggcattaaacgccgcatgcagacctatgcgaatgtgcagataagtgcgcagagccgtgacttcctgctggcgtgggatccgcattactttactcaacatacccagcgcgccagccagtttttgcggcagcgtgcgcgcttcgctttcaggccagacaaaggtgtaaatcaccgccgacaccacggtaccaatgatgatacccagagcgcgatcgcgaatttccaccaggtcgtacaccgggccaaaaacgttttcgagcgtggcgagcgcgaaggtgaccaccatctgtgtgccgatataagaagagcgttcagagctggtggcaatccatgcgcccaacaggaaaatcggtgccagcacaaacagcaattcgacaatattgtccagccagggcatgaccagtagcgtgaataacagcgccagaatcgcgccgcaaaaggccccaccaaaacgcagcaccatcttctggtacgacgaaccgacatttggattagcgacgatcacgcaggtcagcatacaggtatgaatgccttcccagtccacgccgctgtagaaggtgtaacagatcaaacaggcgagcagcgtttttaccgcgtagcgcatatagtctggattggtaaaagcatcggcgaccattgatggcggtttggctgcgggcgttggcggcgtattcgggtccatctgaccaagctgtaacagcgtctggcagatattctccaggttacattcccgtgccgtcatcgcttcactttcactgatccgccagtcgctttgccagcactgaccttcggtaatggaatgctgcagcttgttgatttctgaagctaatttttgtcggaattcaataattgcctgagaatcagcaaaagaggtgggatcgtagcgattcagtgtcgagtaaatgtaggttaccgttgccacgcagctttgccaccatgcgctctgggttcgccagttggcatcgtccgcgaggcaaaagacattgagtttttgcagcgccagcgcctctctttcaatccgcgtttcgggtagcggtgcgaggctgtccgtcaggtggctaatggcatcatcaagccgatcattaagcgcctgatgcatctgcataatggcacgactgggaaaccacagcacgccgattaacgtcatcagcaaggttggatagaggccaacaacgatacaccacagcgttaagcgcacgaccgcttccggatagtcgagcatggcggggaaggtttgcccgtaaatagcgacaatggcgacggcgaaaaagaccagccccaaccgatgggtgcgcatcaaaaacatacagctcatcaggatcggcccggcaatgatcaatcggatcaacggttcgccatatgaccatttgtagatcaaaaacaggctggcgatctccagcaccgtggcgaccacaaacaagatcgctacaaatttggtgtaaaacgcgttcgactgaataccgtaaaacagcactgccagtgataacgccacaaaagggatctcaaaagtcatcgagatcagaatcaccagcaggcaacctacccagagttgcatcgtctgtggcacgcgccctggtcgccgctcgcttaactcttcatgaaagaacgccagcagcctgaccaccggtaatggcagggagttgagcgcgctcattattgcggctcaagattagcgactgccgaagcgccgatgcggaacatttccgggtcaggtttatcgaccatgattttgaccggaaaacgctgggcaacgcggacccagttaatagaacgagacactttcggcaggccgcccagcaccaggccgccgtcatccggtagcacgccgtagccaatcgaatccactttaccctcgaaggttttgccgctgtcgctcatcaggcgaatggttgcgggtgtacccgagcgaatatttttcagatcagtttcgcggaagttggcaatcacgtaccagtgacgagtgtcgattagagtgaaaatagggcgcatcgcagatgcaaactgcccgacggaggttttgagggaaatgacccggccatcaaacggcgcgcgaacggtcgccatttccagatgcagtttggtcagggcaatatccgcttccactgccgcacgctgcgccaccagcgcatccacgccgctgacggcgctggcggctgactgcgcctgcaacaatacggcattaaggtccgcttctgccgcacgctgtgcggttcttgcacggtcaacctcttccgcagaaacaaaaccttctcgcagtagcggttcggtacggcgtaacgtatcgctggcttgtttcgcggcggcacgggctttttctaccgtggcattaaccgagtcggcaccaaactgttgcgcgtcaacgctacgctgggtgagcataatttgcttatccagcgccgcgagggaggcttcagctttcgccagattggcttcgtacgggcgcgggtcaatgcggaacagcaaatcgccctgtttcaccgcttggttgtcggtgaccgccagttcaacaatgcgaccgctgatttccggcaccacatcaatggtatctgctgacgcgtaagcgtcattagttgatggcgcactgtctacgcgccagataacgaaaacaagggcaaccagcgccaacgcaaccactaacagagcagggaatttactgcgaggagcttttttcggcgtactttccatgagcgcgtctcaaatagattagaaaaatgccagccagaacagcatggcgtagagagcaaaaagggcggtataaataattccgacaaatgccagattgatatttgtccgctgaataattcgcctcgtgatgagcgtcaaaataaggctggcaatagcgcagaaaaaccagccgggataataagcgccgatcaccgggatcgccggagataatgagcatcccgataccatgaagacgggaattatccaggctgtctttttgagttgcatcgccatgcgagagagaactgttggcatattaaatacatcctgtctgctgcgaacaatatctgtagtgaatatcaatatccattgaaggcgtcagtatggctattttcttgatgaataaaaatagctttattcagccaccgcattcataacttatatattttatgtattaatttgctgtatatatttttaaaataaatgcttttgggggcttcagcgcccccaaaagcgagtgacattaatttggggttacgatattcacccacaaatcgaaattatccagacaggcgataatttcttccagtttcgcgccattgccaataattttggctttcttcgctttcaccagatcggccattttttgcctgtccggtcagcacggcgtgcagatcttcacggctgatgtagaaagaggcgtcagcttgcggttgcagtgttttacggtagttaagcacgctatcgttcagcgtcaggttgaggttatcgccgttgctcatattgaagttcaggctgatatttttacccgcggctttcgcgctatcgaggcgaacggacataaagtcgaacagcatttcgaccgacatcccacgaatggtgtccggggaaccggtggtgccgtggctgaacttatgccccccttcgcgcagctctttcgcgccggtcaggtagaaatcgcgccatgtggcggactcggcctgatagcccagctgttcaaagttattcgcttgcagattcttcgcgacctggtcacccgggttggcggcaatcacctgtttcagcagttctgccgaccagcgataatcaccttgcttgttcgcttcttgcgccaggttgatgacgcgggcagaaccgcccagcgcctgcacgtaacgtttacccatctccacctgaccatacggatgcaggttagccgggttaccgtcgtaatagccaagatagaagttatataccgcgcgggcgttgtggctgacagaaccgtaatagccgcggctggcccagttattggcaagcgcaggcggcagcttaatcatgtcgccgatttcattcatggtgtagccctggttcgccaggtgcagggtctggtcgtgaatgtacttgatagtatcgcgatatttaccaatataatcattgatatgcttattgccccaaaccggccaggtgtgcggcataaacagtacttccgcgtcgttaccccacatatccaatgtttcgttcagatactcggtccacttgctggtgtcgcgggttttcgcgccgcgcagggtgtagaagttgtgcagggtatgcgtggcattctcggcggtacacagggctttcagggccggaatatagaagtgcatttccgctggcgcttcgctacctggggtcatcaggaagtcaaactccaggccgtcgataatcatcttctcgccagttctcacgatagttttagtcggtgcaataatgctcgggtcgcccgttgccagcgtcacgccaaggccattacccacattgccttgcgcgttgtgcggcagtaacagaccgtaagagtagagcgcacggcggctcatgatgttacccgccagcacgttttcgctgatggcttcgtccataaagccagctggagcaatcacctgaacttttccggatttaacatcggcttcagagatgatgcctttcacgccgccatagtggtcggcgtggctgtgggtatagataacggcaataatgggtttttgcgggcgatgctggaagtaaaggtcaagtgcggcttttgcggcaggtggcgtcaccagtgggtcaataacaataatgcctttctcgccctcaacgaacgtaatgttagagatatcctggccgcgcacctgatacattttatcggtgactttgaacaggcctgaaatgccgttgatctgcgactgacgccacaggctggggtttacggtttccggcgcagcggcattaatatcaaatttgtaatcattcgcgcggtagtaaattttaccgttcgcatcacgcagaataccttcatccagcagcggagcgataaatccacgctgggcatcgtcaaaatcctgacgatcgctaaacggtaatgatttggcgtaattctgattaacctgttgggtatattgagtggcggctttcgcttcatctgttgcgtaagcggtatttatcatcatgccgctggcggcagtgaacgcaataacaatcctgctcaaacggaataaccgagagttattcatataaatctccatttatcatttatgtcgtaaatatgtaatccatgcaaaatacgtcatttaaagctggcgttatcataattctgaaattgcgactttaataagtggaagtgtgagcggaacgagccattttattaggcatttgtgctgaagagggaaaattacagtagaactatcattgctggaaataatatgggctgttttatgtaattattatatatattgtacctgtcgttggcacagcgggacattgcgctactgtgccaacgctttactcatgggactttagcacaggactgtggcaaaaaacgttgatgcgccaatattgctgcaccctgagcgccattaaagtcagaagatgaggcggcaataaagcgcacaacctgatacggcagtggacggcgcaggtacttttgggtcatggcaatgagagtctcgcgtgggaaggcgggcatatccatcacgccaccgcccagaatcaccgcatcgggatcgaacagattaatgctggtggcaatggctcgtgccgcgttttcaagcagactctggacgaaaggggcgttttccgcatggacgaaaagatcgctcaatgggtaatttcggggctgttgttcgtaccagcgtcttagcgccattccagagcaattggtttccaggcacccagaattgccacacgcgcagtgttgggtcatatctcccagggggatatggcccagttcgcctgccacaccgtgtgcacccgtccacggcgcaccgttcatccacactgcgaaccccatccccgtaccgagataggctgccagaaccagttgttgcgtaaggcggttttctactacgtcccaggagagttgcaggttaacgtcgcgggaaaactcaaccggacaattcagcgtattttcgagcttatcggcgagatcatataaatctgccgctgttaacggcaggttaggcgtagaaataatggtgcgtttatctttactgaccagcgccggaaatcccatcaccagaccatgacagcgagcgttaaagcgcctgagttgctcgtcaatcatttcgccgatacccgacaccaggtcgggagcaataacttctgcggtccgctttttttcgcagtgtagcgtttcaccttctgctgtccgcagacaaaagcggatatgcgttgcccccatatccacgcccgctacgacgttatgctgtttttgcatgaggctgtacctcgctttttgcagccagaatctgcgcggtcataattctccatgcttcgtcgatattttccgcatgattaaacaggccggaagtgccgacgataaagacatccgcccctgccgccattagtttttcgtaagttgcctggttgcaggaaccgtccacctcaatttcgtactccagaccttctcgttcacgccatgccttcagttcggcaactttatccagcatttcaggaatgaagggttgtccggcaaaaccgggatcgacagtcatgaccgtaattttatcagccttatggatatagtatttcatggcctcaaccggcgtttccggattaagaatcagccccactttcatgccatgacggcggatttcatcaatcaggcggaatgcctgaccgttgatagtttccggatgcaaagtgatgaaatcagcccccgcacgtgccagttgagcaatgtaatcctgcggacgcgttaccatcagatggcagtcgagcggtttactcgccagtttttttacctggcttacgaagaacggtgagagcgtcagattcggcacaaagtggccgtccatgatatcgatgtgaaagtaatcggcatggctgtcgataaattcgatctgttctttaaatttcagcagatccatacacattaacgagggggagattttcatgttcaattccttacttactgataagacggtcaagggcgacagccgcgataattaatccgcccatcaccaccagttggtaataggtttgtacctgcaaaatattcagaccgttgttgatggtgccgatgatcaacccgccaatcaccacagagaaaatgcgccccttgccgccgaagaaactggtgccgccaatgatggcgctggcaatggcataggtttcaaaacccataccggcaagcggttctgcggcaccgagtcgtgcagttgagacgacgcctgccagacctgcacaaacaccggagatgataaacaccaccaggatgtggaatttcacgtcaatcccggaatagaacgccgagtttttgttgccgcccagtgcgtagatgttgcgtccgagccgcatacgcgttgtcagaaaccaaaggatgagcgcgacaattagcgagaagataacggggacaggtatcccaattacgctggcggcaaagaagttcacgaagtcaaatgagaagccgtataccgagttggcatcggagatcaccagcgtgatcccacggaaaatagcgttggtgccaagggtgataatgaacgggtgtagtcccgtccagttgaccaggcagccgttgatcgcccccagtgcgccgccaaccagtacaccgccaattagcgccgcgagaaacggatcaatacctgccaacatcagtttagcggtcaccataccggaaagcgccagaatcgcgccaaccgaaaggtcgataccggcgaccaggatagcgaagaattcccccatgccgatcagtaccgtcacggagctttgcacaaaaatctgggtaatattattggtggtcagaaaatattctggcgacagcgaaccaaaaatggcgacgatgatcgccaggataaaaaaggtgccgtatttatcccagaacagcgcaaagttgaacggtttcttctcgctcgcttcgctttttactcttgtggtaaagcccatgccataatctcctcttcgctcatgtcatcgcgattggtcaggatttgcgtcagtcgtccttcgcagaacacggcgatgcggtcgcagacggtgataatttcaggtagttcagatgacaccatcaggatgacttttccgtcgtccgccagttggcgcatcactttgtaaatttcggctttcgcgccaacatcgatgccacgggtaggttcatcgaaaatgatcacttccgggcgacagcacagccatttggagatcaggactttctgctggttaccgccggagagttcagtgatgttctggtttaccgaatgacatttcagcgccagcagttcgcgttgattttcagcggtacgttgctcgtcaacttcatgaaacaaccccatcgcgcctttatagccgccgtctttcagactgcggctgatagccatgttctgagcgatagaaaagttggggaaaaagccgttatcccggcggctttcagtgatgtaagccatcccttttttcacggcatccaggggagaacgtggagagatatctttgccattaagacggatttctccgccagcgcgtttatcaacgccaaacaggcagttcatcagctctgtacgtccggaaccgaccagcccggcaaagcctaatatttctccccggcagacgctaaatgagatatcccggaccttttttctgtcacggctggtgacgttgcgcacctcaaaaaccgtatcgtgcgcaaggttgctgacattctccttcatcgcgttaaaacggttttgcaattcgcggcctaccatcagacggacgatatcgtcatttgacacatcgctcaccatgccgctgcaaacgctgctgccgtctttcatcaccgtatagcggtcgcaaatacggcgaatttccgccaatttatgcgagatatagacgatggccgtaccctccttacgcaactgattcatgatcagaaacagatagtccacctctttattggtgagtgaggaggtgggttcatccatgatgatgactttggcatcgagcatcagcgttttggcaatttccagcatctgcttgtggctgatagataagttcgccactttctcatctaaatcaactttcaagcccacgcgtaataacatcatggcggcgcggacacgcatttctcgccagtcgataatattgacgccacagatttttttcgtcagatgacgaccaatatataaattttccagtacggttaattcatcaataacgctgagttcctgataaataatcccgataccgagttgtgccgctaatttatgatccagtttgttatagttaatgttattaatggtaatggtgcctttggtcggctcatgtatcccggataacactttcattagcgtggatttacccgcgccattttctcctagtaatgcatgtatttcaccaggataaaccgttaaattaaccgactttaatgcgtgaaccggaccaaaggacttgccgatccccgccatcgatatatatggcgtggccataaataacctctctgcacgaaatatcgtattattgcctgatgggctacacttatcaggtctacgttcaggttattttgttggccggataagactctttattagcatcatcatccggcatcattcagttttattgagtgaccaggattgaatcgaccagtttaaattccggtgctttatccagcgggataaccttgccggatttctcagcgtcaaccatcagcttcagacccgttgcaccgatatccgccgggttctgggcaaccgtcgcggtcatttgtccggcttccaccattttgcgggcttccggaatgccatctgtaccgacgaccagcacttttcccgtttttctggcgtttgcgacagcctgagcaacacccattgccatcgtgtcattcgcgcaatagatcgctttaatattcggattacgttgcaacacgttagtggcgacatccagtgctttaatacggtcccagtcggcaggctggctggcgacaagcttgatctggcttgcttttttgaaggcttcggtggcaccattacgacgcgcttcaccggaggcgttaccggctttaccctcaatgattgcgactttacccccttcggcacccagcttgtcaataatgaatgacgcgcctttcgccccgacggcaacattatcggtggtgacaaaaccttccacattaccgcctgcttttttcagattatccatgtcgattttttcatcgagattgaccagataaatgccttttttccatgcgcgggcgacaggcatgaccaggttcactgaggataatggtgcgaaggcgatacctttgtaatttttattactgagatcttcaaataactgcaattgagattgaaaatcgccttctgaaggagaggcaaaaatatcaacgctgacgcccagcgtttttgcttcatcttcaatgccttttttcatatctacccaaaatggattggagagtgttttcaatacgacggcatattcggcggcagcaaaagcgctggttgacaacattaagcccacgagtgtgccgctgaaatatttcagatatttattcataatcatgttctcacggtaaggggagaggtaactccgcgatggcggaattacctttttcttatttcagcgcgcctggtgagaagaaatcaacaattgcgccggttttttgcatattaatattagcttgttcaatattgagctgggcgacagagacaaaaaacgcgtccagcaaagtcagttgtaatattcttgccgaggcattacgacctaataacggtgtttccggggccggtgagcaaataatataatcggccagcttcgctattggtgaatgatagctatgcgttatacaaataatctttgccccgttcttttttgccagttctacagccgcttttacatcactggttcgcccggaatgagtcaccaccagcaccacatctccttcctgtaacaacgaagcagacatcatcatgatgtgagcgtccggataggcctggcagcgtacgccaatgcgcaaaaacttgtgctgtacatcagcacagatagcatttgatcctccggcaccgtacaaatcccgctgtctggcctgatagaaaaagcgggcggcacggtggatctcatcaacgttgacgatcgactgaccttccataatggtgcgtaaagtgatgttaaataccttattcaccacatcctgcggcgcttcatcaaaagccaactcggaaggcaatacttgttctgactgagaaaaataatcttccagcgcactgcgtaagttacgaaagccgctaaaccccagcagctttgataccttaacgatcatcgcttcagataccgccagagcttctgcgacatctttaattgcgggtgcacaactcaggttaccgggtttgagtaaccactccacgatgcggctttcgttttctgtcattccttcctgcttcattcgcaggtaaggcgctaacccgataccgttcggaagcgctgaatcaaactctgactggctcatcacgttctcttgtccttgaattgaagacgccactatatcaccacagcaagaacagaaaagatgctggcaacttcacaaaaaaataaaatttataaagtttgttttgttgtgaataatggagagtggcttaaaatttcgtttcatttaatcactttaaaaacatgatgttatttgttttcctggtttattagatgatagatgttgctggatagtgagtgtctttaacgctattgcgctgccagatgtaactctgtaaaacagatcgggaaggcggatttcatcgattttgggtgtttttaattcatttacatcacaaatgttttttgattgtgaagttttgcgcgggcggggaagatgaatgaaaaagattgcatttggctgtgatcatgtcggtttcattttaaaacatgaaatagtggcacatttagttgagcgtgacgttgaagtgattgataaaggaacctggtcgtcagagcgtactgattatccgcattacgccagccaagtcgcactggccgttgctggcggagaggctgatggcgggattttgatttgtggcactggcgtcggtatttcgatagcggcgaacaagtttgccggaattcgcgcggtcgtttgtagcgaaccttattccgcgcaactttcgcggcagcataacgacaccaacgtgctggcttttggttcacgagtggttggcctcgaactggcaaaaatgattgtcgatgcgtggctgggcgcacagtacgaaggcggtcgtcatcaacaacgcgtggaggcgattacggcaatagagcagcaaaggaattgagattcatccactacttgcatggatgagtaatgactaatgtggatagagtttctttttgaggttggctaatgaaacgctttccgctatttcttttattcaccccgctcacgctgtccaccgttccggcccaggccgatattatcgacgacaccattggcaatattcagcaggcgattaacgacgcttataaccctgaccgtgggcgagactatgaagattcgcgcgacgacggctggcagcgtgaagtgagcgacgatcggcgcagacaatatgatgaccgccgccgccagtttgaagatcgccgcaggcagctggacgatcgccagcgccagcttgatcaggagcgtcggcaactggaagatgaagagcggagaatggaagatgagtatgggcgttgaggtaggggccggcgcgggtattttccctcactccacctcaatctccatcccatcaaatcccgcctcaaaccccgacggcagtgcgttttccatcagccacgcatcaaactgatggctgatatgggtcagaatcacccgcggcgagcggataacctgattcagcgcaagcacggtatttaaatcacagtgattacgcggtgcatcctcgcgcggcgggtggctgcaatcaatcaccattacctgtggctgattattgcgtaaaaatttcagcgttttttccggcaggcctgcagtgtcagacagccacgccacccggctatgtgccgtttccagtagatagccgaaagtgagtttcgaatggttaagcggcagcggcgtgacctgcaacccctgcaaatcaaacaccacaaacggctccaccgtgtggctgaaatcaagcaggcccggatgtttaaacagatcgtcgcagccctgctcatccggtggaccgtagaccgggattgtgtcgcccacgccccagcgcagcgggaacagcccctggacgtgatccatatggtagtgcgtcagcaaaaactgctggaacgatccgggcgaccagcgatcggcgagatcgtgcagcccggcgtcgatcagggtgatcgcgtcgttaaacttcacgacgccgctgcatggctggcggcgatactgcggcgagcgtcgcgctctggcgcaggccgcgcactcgcagccccatgccggaacgccctgtgcgccgccggtgccggtgagcgtgagggtcaggctcatgttacagcgccttggtgaagcggaagtggctctgctcgtagccttcgcgcaggtaaaatcggtgcgcgtcgtggcgcttcacgttggtggaaagctcggtcatttcggccccggcctggcgggcttcttcttctgcccatgccagtaatttactgccgacattcagaccgcgcgcctgcggcatcaccaccagttcctgaatttcgccgatccagttgacatgatgcagatgaaactgcaaatgcaggccgatcatgccgacaacctcgccatccaacagcgccagatggtagcgcatattcgggtcacgcaggttggcgttaaagcccacgcgaaacgcctggtggtcaaactccgcttgttttagctcacaaatcagcgcgtaaaccgcgtcggtgtcgtactgcgtagccgggcgaagctcacaagcaggcatggtgtttctccttctgatgaatcagcgtcagcagcttgtcgaccgactggcgcaggctgccgtcattattgagcgtaagacaatcctgaggagtatagcgggcagcgcgcgccagccgggcgttaatttcactggcattttcacgaccacggttttccaggcgctggcgcaggatctctggcgaaacctgtaaacaaacgggcagcagcgccgattgatagcgcgcccgcgcctgcggcagatgggcgcgtgagccgttgaccaccacgtcaaatccagcgtgcagccagaggtcaatctcgacgccgacgccataatacagaccgttagcgtgccagcttaaggccagaaggttctgccccgcgcgggtaaaaaactcctgctcgctcagggcgatatggttttcacttccggcgctggcggcgcgcgtgatgtagcgatgcgctaccagtagctgagtttgttcccgctggcggagttccgtcaacagactgtcttttccggagccagaggcccccattaaccaaatcagttttcccgtcatcagaacacccttttaccctgacgccagacgtggtcgatatgaatgtggttgcccttgcgatgcgccagcaccaggtcggcgcgtttgccctcgccaatcaccccgcgatcctgaagattaagcgcctgcgccggatttttagtcaccagcttcaccgcctgcggcagcgtaaagcggttgctctcgtcatcggcgacgcgaaatgccgcatcgagcaggctggcgaggtagtagtcggaagagaggatatccagcaggccaagctgtgccagttcactggccgccacgttgccggagtgcgaaccgccgcgcacgatattcggcgcgcccatcagcacgttcatgccatgcttgcgcgaggcttctgccgcttcgaacgtggtgggaaattcggcgatcacgctgccaagctggtgggattcggcaacgtgggcgtgcgtggcgtcatcgtggctggcgagggcaatgtgtcgcgcgcggcacattgcggcgatagtttcgcgattaggctgtgaccagcgtgcggcaagcgccagttgctcctcttcgtactgttgcatctgcgcatcggtgagcgagtatttgccctgataatattcacgatatttttcgcggttggcgaactggcgctggcccggtgagtgatccatcagcgacaccagcgttaccagttcgcgctgtaccagtttttcaaacagcggcagcgtggtgtgatgcggcagttcgcagcgtaggtgcagacggtgctcggcacggttgacgccgcgtttctgcgtctcttcgatggcgttgatcatcttctccagattctccagccgatcgccgccgtcgcgtacatcaccaatcgccacggcgtccagcacggtggtgatgccgctcgccaccatcagcgcgtcgtggctgctcatcgccgagtgggctggccagtcaactttcgggcgcggggtgaagaatttatccagattatcggtatgcagctcaatcagccccggtagcagccagccgccttcgccgtccattgcttctgacaggtgactctggctttcggcaaaggcgcggatttcgccgtcctgcatctccagagaaccgtgtaccacctcgttttccagcaccagtttgacgttattgataatcatgaagagactcccattgggtgcaggcggtcggcgacttgctcgcgcacggtttcgtcatggaagataccgacgatggccgcgccgcgggctttggcttcgcggatcagttccactacggcggcgctgtttttagcgtccagcgaggcggtaggttcgtcgagcagcagaatggggtagtcgacgataaagccacgggcgatgttgacacgctgctgttcgccgccggagaaggtcgatggtgccaggtgccacaggcgttcaggcacgttcaggtgggtgaggagacgcgcggctttagcggcgcaggcttcacgcggtacgccggtatcgagcagcggctgcatcaccacttccagtgccgaaatacgtgggatgacgcgcagaaactggcttacccagccgacagtggttttgcggatctccaccactttgcgcgctggcgcggtgaccaggtcgacccattcatcaccgtgtttgatctggatttgcccttcgtcgggtagatagttggcatacagcgagcgtagcagagttgattttccactgccggaatggccgtggagtaccacgcattcgccggcgttgacggtgagtgaggcgccttgtaatacaggcaggcgcacgccgttttgctggtgcaggatgaaggttttactgacgttttgtacgttaatcatttttcgcctcgtggttcgggtgtcggatgcgacgctgatgcgtcttatccgacctacggggagcgcatttgtaggccggataaggcgtttacgccgcatccggcaccagctcaattctgcaaaaccgatgacaccagcaactgggtatacggatggtgcgggtcgtcgagcacgcggtcggttaacccactctccaccactttcccttgcttcattaccagcaaacggtccgccagcagacgggcgacgcctaaatcgtgggtgacaatcaccaccgccaggttaagctccatcaccagaccgcggagcaggtccagcaggcgcgcctgtaccgacacatccagcccgccagtgggttcatccataaacaccagcttcggatgcgtcaccaggttgcgggcaatctgcaaacgttgctgcatgccgccggaaaaggtggtcggcaggtcgtcgatccggttggcgggaatctccacctcttccagccatttctgcgcggtggcgcgaatatcgccgtaatgacgcgctccggttgccatcaaccgttcgccgatattgccgcctgccgacacctggcggcgcaggccgtcaagcggatgctgatgcaccacaccccattcggtgcgcagcaggcgacggcggtcggcctcgctcatcgcgtacagcgaacggttctcgtagcgaatttccccttgctgtggtgtcaggcgggcggaaattgatttcagtagcgtggtcttcccggaaccggactccccaacaatgcccagaacttctcccggccataaatcaaaagagacatcgctgaagcctttgcccggggcataaaggtgggtcaggttattgaccgaaagtaacggttgattcattggcttttggcctcgctctgttggcggcaataatcggtatcggagcagacaaacatgcggtttccggcgtcatccagcaccacttcatcaagatagctgtgggtcgatccgcagatggcgcatggttcatcccactgctggacggtgaacggatgatcatcgaaatcgaggctttccacgcgggtaaacggtggcacggcatagatgcgcttctcgcgccccgcgccaaacagttgcagggcgggcatcatgtccattttcgggttatcgaatttcgggatcggcgacgggtccattacgtagcgcccgttcaccttcaccggataggcgtaggtggtggcgatatgaccgaagcgggcgatatcttcatacagtttcacctgcatcacgccgtactcctccagcgcgtgcatggtgcgcgtttccgtctctcgcggctcaataaagcgcagcggttcggggatcggcacctggaagataactatctgatcttcggtcagcggcgtttcgggtatgcggtgacgcgtctggataagtgtcgcatcgtccgtgcgctcggtggtgttcaccccggtcacgcgcttaaagaagttacgaatcgacacggcgttggtggtgtcgtctgcgccctggtcaatcaccttcaacacgtcgctttcgccaatcacgctggcggtgagctgaatgccgccggttccccagccgtagggcatcggcatctcgcgtccgccaaacggcacctgataaccggggattgccaccgcttttaagatagcgcggcggatcatgcgtttggtctgctcgtcgaggtaagcaaagttgtagccgctcagattagccatggttctgctcctgttgcagacgtttgagtagctccagttcggcctggaaatcgacgtagtgcgggagtttgagatgcgaaacaaagcctgcggcttcgacgttgtcggcatgggccagcacgaactcttcatcctgtgccggacctgttgcgtgctcgccgtattccggtgcctgcaacgcacggtcaaccagcgccatcgccattgctttgcgctcgctcatgccgaacaccagcccatagccgcgtgtaaaatgcggtggttcatccggcgggtcgataaaaccgttgaccatttcacactcggtcatcaacaattcgccgacgttcaccgcaaatcccagctcttccggcacaataaatatatcgatatagccactgcgaatttcgcctgcgaacgggtgattgcgcccgtaaccgcgttgggtggagtaggccagcgccaacaaatagccttcgtcaccgcgcattaattgttgtagacgggaagaacgcgaacagggataaaccggcggcgtgcgggtgatgtcgtccggttgtgcgccgctatcttcttcaaacttcgccagcccctgacgcgccagcaggctgaagacgtgtggcgacggttgctgttcgctgtcagcggtggtcagcgttggcgtttcgccgtttgccagcagggtgaaatcgagcaggcgatgggtgtagtcgtaggtggggccaagcagttggccgccgggaatgtctttataaattgctgaaatacgccgttcgagacgcatcccggtggtgtcgagcggctcactgaccgccagcttcgccagcgtggtgcggtaggcgcgcaacagaaaaatcgcttcgacgttatcgccgctggcctgtttcagcgccagcgcggccagctcgcggtcggcaataccgccttcggtcatcacgcgatctaccgcgaggttaagctgctgttcaatctgggcgacgctcagttcaggcaaatcagtatcgccccggcgtcggctctcttgcagggcgtgggcggcgtcgatcgccttttcgccccctttcacggcaacgtacatcagcacacctccacatgagtggttcgcggaatagccagcaggcgctcgccgcaggtcaggatcaggtcgatgccgagcgggaacgggtgcgggcgctcggtaagttcgtgcagaatgcactccggcagctgcggggcgatcattcgttcttcggcaatacccgcgccagtaaggcgcagcatgcgcccgccgctcaggctgacgacctgtaaaatcagcgtcgtgcccgcttctggcgcaacagcggtgccgctggaaagggcgttaagctgttcgctggaaatcgcctcatccgttaccgcgaaggtcgccagttccggctgattgaccagcggcgcgttggtatgaaaacgcaggctctggctgacgatatcgttacttaatggcgcagaaagccacaccggcgtgtcgttatcggccagcgtcagcagcacgctggtggtggcgatattcagcggctgccagccgcgtttgagctgatgcagggcgacaatcacgcccggctcgctcatggcctttaacaggcgacgaaaactgtgctgggcatcctgcacgggaagcataaaagcggtttccagggtcatgcgttatctccgcgaaccatcgtaaagaagtagacccggctggcgtttacttcggcctggcgtgcggcaatgcgtgccatacggtcagcgttcagcggggcaataagagtttctgataagttttgaaaatggcgggtttgctgcatcagcgcgtcgatcagcgcgcagcgttcggcgtgctgtttgtcgcgccccagcacccagctgtagccgagcgtgccgtcagtcaggcgtacggcggcgcgggtgagcgtggcgtcgccagcaaaaaagcgttcgccggtgccacccatccgcgcctgaatctgcaccaggccggtttcagcggcgcggattacttcatagtcggcggtgatgttcagcgcgttcaggcgggctgccagttcagccggttggctgtgtgccagtacggacatccagtgctggcgggtcgcggtatctgcgtgcattcagtgctccatagtgaattcaatcatgtcggcgcgcgtcaggctgacggagtactccgccgggccgctttcaccgtcacggtggttaagggtgcgcacgcacagcagcggcgacatattcgggatttcaagacgctggcactctttggcctgggcgcggcgggcgctgatccgcgtctggctgcggcgcagcgcaattccggtttgctcgcgcagaaaatcgtgcagcgagccgctgtcgaagcgttgcagcgtcggccagagggcgaggtccgcaaagtagtggtcgattaaacagagcgcgacgccgttgacccgacgcagggtgcgcaggtggataacgttctcgccctcggtaatccccaatgcgtcagcgacgtgaccggaggccgggcgcagcacagacagcagtttttcgctggtgggatggctcccctgatccagcaggttctggctaaaacgcgcctgggtgtggagcgggtaatcgaacgggcgcatcagcaccagtacgccgacgccctgacggcgctgtacccagcctttttccaccagttggtcgatggcgcggcgcagggtgtggcggttcacctcaaagcgcgccgccagttgctgctcggcgggaagatagtcgccgcagcggtagtgttgacgaagctcctgctcaagttttgcggctatctcctgatagcgtgttgggtagctggtcggatgtgtagacaagtgcatagccatcaatgcctcgcttatcagataaagtgcttacgcaaccgttgagagaggaaatccagcaggctgaccgtgacgatgatgagcaccatcagggcgcaggtttgctggaactggaaaccgcgaatcgcttcccacagcgtgacgccgatcccgcccgcgccaaccataccgacgacggtcgccgagcggacgttggattcgaagcgatagagagagtaggaaatcagcagcggcatgacctgcggtagtacgccgtagaggatctcttccagcttgttggcaccggtagcgcgaatgccctccaccgggccgggttcaatcgcttctaccgcttcggaaagcagtttggaaagtacgccggtggtgtggataaacagcgccagcacgccagcgaacgggccgaggccgacggcgaccacgaacagcatggcgaagaccatttcgttaatggcgcggcaggcgtccatcaggcggcgtacaggttggtagacccaccacggtaccaggttttcagcgctcatcaggccgaaggggatggagagaaccaccgccagcgcggtgccccagacggcgatttgcagcgtgacggccatttcggtgaggtaatcctgccactggctgaaatcgggcgggaagaagtcggcggcgaacgtcgccatgttgccgccatctttaatcagcgtaagcggtgccatttccgcgccctgccacgagacgaccagcacggcgataacaacggcccagctcagaagcgagaaccagctgcgcttgggtggggcgatggtgatggtttgcatgtttggctccggtctgtaggccggataaggtgcttgcaccgcatccggcatcaacgtctgcacattgtcggatgcgacgccggggcgtcttatccgacctacgatttactgcaccgctttactcaccgaactcattgcgcttaacgcgttgttcaggcggtccaaatcatccagttgcgcctgaatggcggtggtttttgccagcttgtcctgttcgttcagccctttgttgtccttcacgctttgcatctctttaaacagcgcgagctggcgaatcggcaccagttgcaggtcgctggaggcgcggaacggcgcccagcccaggcgttccagcaccgctttctcttccggcgttttgccgtagttcataaagaagtcgtagatcttgtctttggtggtttcggacagatttttgcgccagacgatcggatcgcctgggatcagcggcgatttccagatcaccttcagttctttgagcttctctggtgcggaggttttcagcttgtcgaggttttcggtgttattggtcgccacatccacttgcttgttggcgacggccagcgcattggtttcatgcccggcgttgacggtgcgcttgaagtcgctggcggagatattgtttttagcgaagacgtagtaaccggggacgaggaagccggaggtagagttaggatcgccattgccgaaggtgagatctttccgcttcgccagcagatcgttcaggttgttgatcgggctatctttgttgacgatcaacacgctccagtaacccggcgatccatccgccgcgaccgtctgggcgaagacctggccgttggcgcgatccaccgcttccatcgccgacaggttgccgtaccaggcgatatccactttattgaagcgcatcccctggataatgcccgcgtagtccggggcaaagaaggcgttgacctttacgcccagcttcttctccatatcctgtaagaacggcgtccattgcggtttcaggttttgctgtgattccgttgaaataatgccgaaattcagcgccttttcctgctcttcggcgtatgccggatttaacagggtgctgaggctgaacatgctggtgaaggccagcgaggcaattatcttagcgttcattcgttttcctcaatgatggggatgtcaggcagctttcgcgttctcttcgacgcggttaatgctgcggtagagatggtcaaaacgttcgttatcaaactgttggctgcagccgtcgtagaagacgtgcccctggcgcagggcgacgatgcgtttgcagtagcgcagggcgtaatccacctgatgcagcgtgacgaccacggtaatgccgtcgttctggttgatgtcgcgcagggtgtccatcacgatgcgtgccgattccgggtccagcgaggcgatgggttcgtcagcgagaatgaccttcgcctgctgcatcagcgcgcgggcaatcgccacacgctgttgctggccgccggagagtgtggaaacgcgttgatgggcaaagtgcaccatgccaacgcgggtcagcgcctgtaacgcgcgctgtttctgctcgcgggtgaagtagctaaaacaggttcgccagaatggcgtgctgccgagcgcgccaatcagcacgttctccagtacgctcaggcgattcaccaggttgaattgttgaaagatgtagccggtatgggcgcggcttttgcggatatcgcgggccagacggccttcgcgctggacagtgcggcccagcagctcgatatggctaccgacagatttatcgccggtaatcaaaccgcttaagtgacgtaaaagggtggattttccggaacccgacggcccaagcagagccaccatttcaccatgatgaatgttcagatcaaccgcgtgcagcgcctgatgctgattgaaggttttggcgagcttctcgacacggataatcgtttgcatgatgcagcctccctaaaaaagtggctccatcgtggcggattattgtgacgatttggttaattaaaagtgactaacagatgaagagttaacgggaattcgatgacagtgcgggagggcgggcctcccggcgggttattgcgttggctgttgtttgatgacattaatcatccacggtacgccaaatttatcggtgactttgccaaagccatgcgcccagaacgtttccagccaggccatttcgatttttccgttggcggcaaggttatcaaaccagcgttttccttcttccacctgttgagaatcgagcaccagcgtaaagccggagtagctggcttttcctgacggtatagcatcgctcatcatgatgtcgcttcctgcaatgcgcacattggcgtgggcgatggcggtatcgggaaattgcattccggaagggcagttctcggcgctgtcctgcgttgattttggcatttcgccgaagctgattttatagagcagttccgcgcccaacgtacgttgataataggcaatcgcgtcggaacagttaccggcaaaagagaggtagggacttaacggcatgatggtgacctcagttaagagaagccagttaagtgtagttcgaaatttatacagatgagagggaagcctgataagacgcggtcagcgtcgcatcaggcagtcgccaccgttgccggatgcggcgcgagcgccttatccggcctaccgatcacaatacaatcagttctttttcacaaactcagacttcagtttcatcggaccaaaaccgtcgattttgcaatcgatgttatggtcgccttcaaccaggcggatgttttttactttggtgccaattttcagcatcgaagagctacctttcactttcagatctttaatgatggtaacgctgtcgccgtcagccagcagattgccgttagcatctttaacgatcagctcgtcgctttcctgtgcaggttctgcgtcgttccattcgtaggcacattccgggcagatgtacatgccgttatcttcgtaggtgtattcggagttgcattttgggcagtgtggtaatgacatgtggatttcctcaaaagtcagcagggcaaaagcgccaaaaaacggcagattgccgaaaaaggccgcaattatacacaaaatccctgagtttgtcgggggtactgctgattttagatgacgatcgttttcatttgaaaggaaacgcaaaaagaaaataatcgttttgcctccatttattatttaagataaggttaatgctctactcgttctttttttaattcacatgatgtttttatctttctgacgttttaaacgtattggaagatgttatttattctaataaaaaacaacacgctaaatataaaattatttcttgcagttattataaaagccgaaaacagaactcaaaaacaatctggctaaataaaagtaataaaatttgctttaaggaagaattttctatgtacacacagaccctgtatgagttaagtcaggaggctgaacgcctgttacagctttctcgccaacagttgcagttactggaaaaaatacctctctctgtacccggagacgatgcgtcacaactggctttaccctggagtcagcctaatatcgccgaacgtcacgcgatgctgaataatgagttgcgtaaaatttcccggctggaaatggtgctggcgattgtcggtaccatgaaagcagggaaatcaaccaccattaatgccattgttggtacggaggttctgcctaatcgcaatcgcccaatgactgcgctgccaacgcttattcgccatacgcccgggcaaaaagaaccggtactgcatttttcacatgtcgcgccaatcgaccatttaattcaacaattacaacagcgcctgcgtgattgcgatattaagcatctgaccgatgtgctggaaatagataaagatatgcgtgcgcttatgcagcggatcgaaaatggcatcgctttcgaaaaatattatctgggtgctcaacctatttttcattgtctgaaaagtttgaatgatttggtgcgactggcgaaggcgctggacgtcgattttcctttttctgcttacgccgccattgagcatattcccgtgattgaagtggagtttgtccatctggcggggctggagagttatcccggtcagttgacgttactggatacccccgggccaaatgaagccgggcaaccgcatctgcaaaaaatgcttaaccagcagctggcacgcgcctcggcggtactggcggtgctggattatacgcaactgaaatcgatctccgatgaagaggtccgtgaggcaattttggcggtggggcaatcggtgccgttgtatgtgctggtcaataagttcgatcaacaggatcgtaacagtgacgacgccgaccaggtgcgggcactgatttccggaacgctgatgaaaggctgtattacgccacagcagatatttccggtgtcgtcgatgtggggctacctggcgaatcgggcgcgccatgagttagccaacaacggtaagttacccgcgccagagcaacaacgctgggtggaagattttgcccatgccgcgctcggcaggcgctggcgtcatgccgatctggcggacttcgaacatattcgccatgctgccgatcagttgtgggaagattcgctgttcgcccagccaattcaggcgttgctttatgccgcttacgctaacgcctcgttgtatgctctgcgatctgccgcgcataaactgttgaattacgcgcagcaggcgcgggaatacctggattttcgtgcgcacgggttaaacgtcgcttgtgatcaattgcagcaaaatatccatcaggtcgaagaaagtttgcagctattgcaactcaatcaggcgcaggtgagcggcgagattaaacatgaaatcgagttggccctgacctccaccaaccactttctgcgtcaacagcaagatgcggtgaatgcgcagttagccgcgttgtttcaggataattcggagtcgttaagtgagatgcgtacccgctgtgagacactgttacagacggcgcagaacaccatcagtcgcgactttacgctgcgctttgccgagcttgagtccaccctttgccgggtgttaaccgatgttattcgccccattgagcaacaagtcaaaatggaattgagtgagtctgggtttcgtcctgggtttcattttcctgtttttcacggcgtagttccccacttcaacacccgccagctgttcagtgaagtcatttcgcgccaggcagcaacggacgagcagagcacgcgtttaggcgttgtgcgtgagattttttcgcgctggttgaatcagcccgactggggacggggaaatgagaaattcccgacagagacggttgattacagtgtgttgcaacgagcattaagcgcagaagtcgatctttattgccaacaaatggctaaagttatggcagagcaggtcgatgaatctgttacggcaggcatgaatacttttttcgctgagttcgcttcatgtttgacggaattacagacgcgtttacgcgaaagtatggctctgcgtcaacaaaatgaatcggtggtcaggctgatgcaacagcaattgcagcagactgtgatgactcacggctggatttacaccgacgctcagctgttacgcgatgatattcaaacacttttcacggcagaacgatattgaccaagacgttactggacggccccggtcgcgtgctggagtcggttcatccgcgctttttagtggatctggcgcagggcgatgatgcccgccttccacaagcccatcagcagcagtttcgtgaacgactgatgcaggaacttcttgcgcgcgtgcagcttcagacatggacgaacggcggcatgttaaatgcgccgcttagtctgcgtctgacattggtggagaaactggcgtcgatgctggatcccggtcatctggcgctgacgcagatcgcgcagcatctggcgctgctgcaaaaaatggatcaccgccagcactctgctttcccggagctcccccagcaaattgtcgccttgtatgagtggttttcagcccgttgtcgctggaaggaaaaggcgttaacgcaacgaggcctattggtgcaggcgggtgaacagagcgagcaaatttttacccgctggcgtgctggggcgtataacgcctggtcgttgcctgggcgctgctttatcgttctggaggagttgcgctggggtgcatttggcgatgcctgccgtctgggaagcccgcaagcggtggcgttgttgctgggtgatttgcgcgtgaaagcgacacaacatttggcagagagtatcaatgcggccccgaccacgcgtcactattaccatcagtggtttgcctcttcgaccgtttcgacgggcggggatcatgctgattttttaagttggctgggaaagtggtctacggcagataaacaacccgtttgctggtcagtgacccaacgctggcgaactgtcgcactggggatgccacgactctgttcagcgcagcgtctggcaggggcaatggtcgaggaaatcttctctgtaaatttggtgtaaataatcagttacaccaatgagtcctaaacgaaatgcatgtgtgaagttgatcacaaatttaaacactggtagggtaaaaaggtcattaactgcccaattcaggcgtcaactggtttgattgtacattccttaaccggagggtgtaagcaaacccgctacgcttgttacagagattgcatcctgcaattcccgctccccttttgcggccgtcgcgctgatttttctggcgtttgcggaaatgggccaactctgcgaggaaagctatgctgaaaaggaaaaaagtaaaaccgattacccttcgtgatgtcaccattattgatgatggtaaactgcgtaaagccattaccgcagcatcactgggtaatgcaatggaatggttcgattttggtgtttatggttttgttgcttacgcattaggtaaagtttttttcccgggggctgaccccagcgtgcagatggttgctgcactcgccactttctccgttccctttctgattcgaccgcttggcgggctcttctttggtatgttgggcgataaatatggtcgccagaagatcctcgctatcactattgtgattatgtcgatcagtacgttctgtattggcttaataccgtcctacgacacgattggtatttgggcaccgattctgctgttgatctgtaagatggcacaaggtttctcggtcggcggtgaatataccggggcgtcaatatttgttgcggaatactcccctgaccgtaaacgtggctttatgggcagctggctggactttggttctattgccgggtttgtgctgggtgctggcgtagtggtgttaatttcgaccattgtcggcgaagagaacttcctcgattggggctggcgtattccgttctttatcgctctgccgttagggattatcgggctttacctgcgccatgcgctggaagagactccggcgttccagcagcatgtcgataaactggaacagggcgaccgcgaaggtttgcaggatggcccgaaagtctcgtttaaagagattgccaccaaacactggcgcagcctgttgacatgtattggtctggtaattgccaccaacgtgacttactacatgttgctgacctatatgccgagttatttgtcgcataacctgcattactccgaagaccacggggtgctgattattatcgccattatgatcggtatgctgtttgttcaaccggtgatgggcttgctgagtgaccgttttggccgtcgtccgtttgtgcttcttggtagtgttgcactgtttgtgttggcgatcccggcgtttattctgattaacagtaacgtcatcggcctgatttttgccggcttattgatgctggcggtgatccttaactgctttacgggcgttatggcttctaccttgcctgcgatgttcccgacgcatatccgttacagcgcgctggcggcggcatttaatatttcggtgctggttgccggtctgacgccaacgctggcggcctggctggtcgaaagctcgcagaatctgatgatgcctgcctattacctgatggtagtggcggtggttggtttaatcaccggcgtaaccatgaaagagacggcgaatcgaccgttgaaaggtgcgacaccagcggcgtcagatatacaggaagcgaaggaaattctcgtcgagcattacgataatatcgagcagaaaatcgatgatattgaccacgagattgccgatttgcaggcgaaacgtacccgcctggtgcagcaacatccgcgaattgatgaataagctgaaacggatggcctgatgtgacgctgtcttatcaggtcaattgaactcttaaggttcacttaatctctgacgcgcatactctcctccaggttaacggaggagagtacaatgaaaaaccgtgtttatgaaagtttaactaccgtgttcagcgtgctggtggtcagcagctttctttatatctggtttgccacgtactgatcttttttcagccgtatccaggcccgcgtgccggaagtctcttgccggttttgcaggaaaaactgcccgtgatgcaactgtgtaatgcggctgacaatacttaaccccagaccaattccgccataacggctgtccattcgtacaaacgctttactcaactccccgcatttactctcatcaatacccggtccttcatcttcaacggccatgatcgctccgccatcttcttgcagcttaatcataatgttgctgccttgcgggctataacgatgggcgttttctaccaggtttcgcaataacatccgcagcagggttgcatcaccctgaacggtgatgtcggcggcgctctctggcaatagcagggtttgctggcgctggtcgagcatggtactgagttcgtcatacgaggggagaatgacatcttccagcagttttacatgttgataattaccggaagaaaatgactgtccggcacgcgccagttgcagcagctgggagacgctctccatcatctgatcaagtcgtgccactaacggtgctacatcaatgtgatgcgttttcgccagcagttccagatgcaaacgcacccccgccagtggcgttcgcagttcgtgcgcgacgtcagcggtaaacaacctttcgttatccagcgtgctggtcaggcgactgaccagatcgtttaatgccgaaaccaccgcatcgatttcgagggtggcgctatgaatggcaatgggcgttaagttatcggcggtgcgcgcttccagctctttttgcagctccgccagcggtcgggtgatgcggcgtaccgcctgatagcagataaatagcgtcaggctaaccataaagacgccggggacaatcaggctggcgaccgcctcgcggatctcacgcatgatgtggcgatcgttgttgcgattgtcgcgtagcgcctgctcaaacagctgaatctgctcggtactttcatgccacagccagaagacgctgatcagctcaaacaccaacaaaatggccccgatggtcaatatcagccgttggcgcagcgatattggtcggcgcagaaaacgcatcagattcaattagttttcctcatttgcgaccagcatatagccaaatccgcgcacggtgcggatacgggctttgcccactttgtcgcgcaggttatggatatgcacttccagggtgttggtcgagggctcgttgtcccagttgtagatatcgttgtagagaatttcccgatgcaccgggctgcctgctttaagcatcaggcgcgacagcagagcatattctttgggcgtcagaatcagttcttctccgctcatccatacctggcggcgacccatattcagcgtcaggttgccaacgttcagctcactttcgccctgattattatggcgtcgtagcagggcgcggatacgggcgtgcaactcttccagcgcaaaaggcttcaccagataatcgtcggccccgacatccagcccggcgattttgtcggtaagggtatcgcgggcggtgagaattaacaccggcagagtgtattttttctgccggatacgggcaagaaaatgcagcccatcttcatcgggtaagcctaaatccagtaccaccaggctgtaatgaccggcttcaaggctttgttccgccatccgcgcggtgctcacgccatcgcacgcgtagccttcggtttgcgccgccagaatcaatccctgcaataacagcgtatcgtcttcaacaatcagaattttcattcactcactctcctgcaagtttgcagaatatcatccgcagcctggtaatacttcgtctcaacgccagtcaggcccaataaggttgagaataaattgtcttgtgaatagtgttgcgtttgcgcctgtttttgcaggcagttctggtcaacctgataccgtttttgataatcctccgatagccacagcagcatcggtacctgtttttggctatccggggcgatggcataaggcagaccgtgcagatagatgccattttcacctaacgattcaccgtggtcagaaagataaaccaggctggtggtaaatttatcctgatgttctttcagcagattaatcgctttatcaacaatatagtcgacgtaaaccagcgtgttgtcgtaagtgttcaccagttgctctttggtacaggtctggatctcgttagtgtcgcaggttggggtaaatttcctgaactgcggcggatagcggttgtaataggtcgggccgtggctgccgatagtgtgtaatacaatgaggccatcgctttgcagattattgatgtgctcttccagcccgtggaacagcacttcgtcatagcattcgccgttgatgcactgaccaggcaggttcagcgcggtgacgttctggtgaggtacgcgatcgcaaacgcctttacagccgccatcgttgtcattccacagcacgttgatgcccgctcgctgaatgatatccagcacgccttcctggtgctgtgccagctcttctttgtagtgctcacgcggcatatccgagaacatgcacggcactgagacggctgttgctgtgccacaagatgcggtattagggaaatagaccacgttatcttttgccaggcgaggattggtttcgcgtggataaccattcagcgagaaattctctgcgcgcgacgtttctccgacgatcaaaatggtcaggtttttgcgtttcccattttgcattaatgggttgcggtgagcatcttcaccaatgcgtatcagtggcaggttggctgaccgctggtgagagtaccacgaccagctagcaacaatgctgttggacgggcttaaggatttcaccagttctttgttgttgcgaaacagcgaggcatagtctttgtagaacagtgcggcaaccagcagaatcagcagtacagaaatcaggatgttggccccgcggaaaagaacgctgcgcaggcgtgaggtggtgggtttgattttgatccagcaggcaataatcgcggccaacacgccacttaaccccagcgttaataacattcgtggcgtcatcaacgcataactttccgccggcgtagtatcaatgatattggtgatcattgaacggtcgatgacgatgccataggtcatgatgaaatattgtgcagccgcaccgaccagaataaacaggcaggcgagtggacgattaagccataagaaagagcctagtgtcaggacaatattaatcacgctgaatgcgacgaccggcatcgacaagaaaaccagcacgttatgcagtgaatccagcggtaacacctgtagcacctgtttaaaaaaggcgatattcaggcagactgagatataaaaagtagcaagtaataaccaggagaataaatttaaagagggtctttttagtaggcgcttcaacatcacggtgtttccatcgaacaaagtgcgcatatgctcgcaaagcaaaattaagccaaccttaagttcttaaggttggcttttatgtttgcttgattaaggggaattaatctttgcttattggtgcatctaagggatacgggtttttatgcagccggttgtaattcagcgcatacatggcggtgattaccatcagagtgacaaatgaccacataacctctttcgcgccggaccctactacggcccagatgcagtagaggaaggcaatggtagtaactgccaggtatgccgggcgtgctttaccaaagtgaccgtggccgagcagcagtaacgccgcacaggtgtaaagatatggcaccagtgtaaagatgaccgacacggaagaaaccagaccgaattctttggtcgcgtttggcgaaatgctactgagctggaagatggtcatcaaaataccgacgataatcagccccgccactggcgtgcccgctttatttacacgggcaaaaatcggtgggaacagtccgtcatcggcagcggctttcgccgtttgacccgccagcaacgtccagccgcccagtgaacctaagcaacccgcagctgcgcagaaggaaacaatggccccggcggtgtcacccaacgccatccgtgcggcatcaccgaatggcgaagcagaaacgcgcagtgcggcattagggatcatccccataatcgcggtggtagaaagtacatagcaaacggcagcaatcaataccccgccaatggtggcgatagggacgttgcgtttcgggtttttcaccacacctgcggcaacggaggcactttccacaccgatgaacgaccacagcgtaacgttaagggtactttgaatcgcaccgaaggtgcccagaccgctgacgttccatgccgccatataggtttcaccacggaaccagaaccagccaaatacggcaatcccgacgatggggatcagcgccagcacggtagcaacggcctgtacgcgggtgatcattttcggaccgacaatgttcagcaggacgaagatccacagcaccacgacgcaggtgatggttaataccaatgggtctttcagaatcgggaagaagtaacttaaatatcctacgccaatgaccaccatggcgatattgccgatccagcaggccagccagtagaggacgttggtttgataaccgagaaacgggccaaagcagcggcgggcgtaagcgtaagaaccaccaggacttgggtcgaggaacgacattttggcgtataccatcgagagccccagcgcaccgataatcgtcaccaaccatccataaatggcaatcccgccagtggaggccaggtttgcaggtaacagaaaaacacctgaccccataatattccccgacaccatcagggtgacggggattaagcccactttgtgagcatcagcatccgaagacataattaaactcctgcgaaggcgagcttcgtgacaataaattacgtcatatcatacgcctgcattcgatagttgaattattatcggccgggttatcgctgatgccgttattaatatagctcttcgttaaggttaaaaatcaggcgacagtgcgttctctgtgctgactaacataatgcagcggcgtcataccgtagaagtctttaaagacagaaataaagtacgacgtactgttgtagccgcaggactgtgatacctgagagatatttttaccgtccatcattaattcatttacggcataacgcatgcggcaggtggtgattatttggctataactggtgttttcgcttttcagctttttctttaacagacttgggctaagacataaacaactggctaccatactaagattccagtctttgtggatatcgctttcaataatttgataaacgctgtcacttacacaattacgtaacatatacatcattagtgaaaggaattttttactgtcgagaaaacgggatagcacagtgaataataatgcacgtgttcgttccttttctgactcagtttcagcgggcatcatgctatgctgcgcggcaacgcgaaagacgtctggcgtcaggcatggaagggtgaggatgggcgtagcgctacgttgccatactggtatttgcgagagatctttattcagaaaccggaggtaatctttgatgatgtcgtgactaatatgagcaaccaaagtgttattaagagaggagacgtcgataatattattttcacaatttaataacgccatgtggttagctttaaggctaataggttctttcccattcacccttatccagacatctttttcagtcaataaaacaatacaaggttggtcgctgcaaatcctcatacatgtactcctgagtgcgaataaaagaccagttctcgctaaagcgaagcgataccgggaaatggttatataattgtatgatgaatataaacatgcataaaaataacgagttttactaatattacaaatttttatagtaatttctcatgtacatatttttttacaggctaaaaaaaggataaataacaggcaaaaaaaagcgcggggtgggaccgcgcaaaaagcatgacattttttgtttgcagcaatttttatgaaaacgttgccatacttaaaaggcctcaagccaggcggcgtaatgttatttaacaattacgccttcagcggaatagtggttacgctttcacacacataacgtggtaaataccgtcaataatttctgtcccttctgtttcgtgttcaaatccagggaaatgatggtcccaggattgcagcgagcgtaaataacttacttgcggactgtttttatcgccgaagttttcaccagacagcagcatcgggattcctggcggatacgggataactgagtttgccgcgatacgtcctggcagattttcaatggatatcagttcgacattgttgtcgacaatcgcgttgtacgcttcacgcggggtgatttccgccaccggtaggccggaataggcttcattcaaccgtgcgccagggttgttttctttcagccaggcaaacatggtgtcacccagatcgtgaatccccatgttcgcgtaagtgtcaggatattgttcaacaagttccggcatcacctgcgccagcggtgtgttggcatcatagtggcgtttgaaggagcaaagggtgttaaccagagtcccccatttcccacgggtcacgcccatagagaacaggaacataatctggaagtcagtggtacgggtaggcacaatgccgtggcgaccaagccaggctgtgaccagcgccgccggaacaccggtttcttccagttcaccatcttcacccattcccggagcaaggatgctgactttaatcgggtcgagcatactccagttatccggaatatctttgaagccgtgccagctttcgcccggatgcatgacccagcagtcctgaacggtggtcagcagtttggttggtgcgtcagcaaagtcataggttttgccggtttgtgggtcggtgacgacttctttgttccacggtttgaagaaccagctaccgtcagcggtgaactctttatatagccgcgccatcgcctgacggaaatcaaccgcttcgtcgatcacttcctgggtcagtgacaggccgctgttgccgtccatcatcgacaccgccacgtcgttggatgcgcagatggcatacagcggggaggtggtggcatgcatcatgtaggcctggttgaagcgggagaagttaatcgccccacgaccttcacgtacatgaatataagaggcctgtgacagcgcattcagcagtttgtggggggagtgggtggcgaaaacggtaggaccgttgtgatcgccaggttcgccgcgcatggcatagtgatcggcatagatcgggttgaaacgtgcatagccgtaccaggcttcgtcaaagtgcagacgatcggaggttttttccagcagatcctgtgcttctttagcgttataacacacgccgtcataggtgcagttggtcaccacgcagtaagacggtttttgcccggctttgtctttggtcagcgggctttcactgattttcttctgcaaggtttcaggttgcatttcctgcggatagattggcccgataatgccgtagcggttgcggcttggcaccatgtagaccggtttcgcgcctgtcagcatcaagccttgttcgatggatttatggcagttacggtcaacgaccacgacatcgttatcggtcatgcaagcctgcatgatggtgcggttagagccggaagtaccgacgactaccgaccaggagcgatcggcaccaaatacgcgtgcggcatatctttcgctttcgccaaatgcgccagtatggtcaagcaaagaaccgagggaagtgcgttcgatgcccatgtcggtgcggaacagattttcaccataatagtcatggtagaaacgtccggcgggtgttttggtaaaaccaacgccgccctggtggcctggcgctgcccaggaatattcatggatgtcgctatatttcatcagcgcgctgaacagtggcggcaatagctgctggcggtagcgggtcatcgcggcaacggcgcgtccggcgataaagtcggcggtatcttccagaatccaggcgaattcatcgacaagctccagcagatcccggtccattgcggcgagggctttttcccgatcgcccaacaggaagaccggcacgttttgttggcgctcatgaagcttaccgatcaattgtctgacgttttgatgttcgtccggatgttccatttgatagctgaacatcaggcagtcaatggcttcgtttgaagagagaatggcaaaaccatcatcaaaggaggtggatttaatcacggtaacattttgctggcttaaagcatctgccagacgctcaacggcgttaccgacccaggtgtcttgatggagaaactcgctttcaacaattaatactttcatcattgcttacccggttatgaaggaatcttcgttgcgggcaagtatcttccggccttttcgggctgtaaagcgcgtgaaaaacaaacatttttgaaatatttatttttataaacaatacgttatgtgattattttaaattattttcactgcttattatcgacggctaaactatttttttggctgatactgatatcgtctttagccgggaaacgtctggcggcgctgttggctaagtttgcggtattgttgcggcgacatgccgacatatttgccgaacgtgctgtaaaaacggctactcgaacgaaagcctgccgtcagggcaatatcgagaatacttttatcggtatcgctcagtaacgcgcgaacgtggttgatgcgcatcgcggtaatgtactgtttcatcgtcaattgcatgacccgctggaatatccccattgcatagttggcgttaagtttgacgtgctcagccacatcgttgatggtcagcgcctgatcatagttttcggcaataaagcccagcatctggctgacataaaattgcgcatggcgcgagacgctgtttttgtgtgtgcgcgaggttttattgaccagaatcggttcccagccagagaggctaaatcgcttgagcatcaggccaatttcatcaatggcgagctggcgaatttgctcgttctgactgtttaattcctgctgccagcggcgcacttcaaacgggctaagttgctgtgtcgccagtgatttgatcaccatgccgtgagtgacgtggttaatcaggtctttatccagcggccaggagagaaacagatgcatcggcagattaaaaatcgccatgctctgacaggttccggtatctgttagttggtgcggtgtacaggcccagaacagcgtgatatgaccctgattgatattcactttttcattgttgatcaggtattccacatcgccatcgaaaggcacattcacttcgacctgaccatgccagtggctggtgggcatgatatgcggtgcgcgaaactcaatttccatccgctggtattctgaatacagcgacagtgggctacgggtctgcttttcgtcgctgctgcacataaacgtatctgtattcatggatgactctctttcctggaatatcagaattatggcaggagtgagggaggatgactgcgaacaggcgcacggttttattcctctccctggaggtgcgaggagagcggatgagaagatttgggtcgattattcagcttttcaggtaatttattctcataaactcagatctattgatgtgccacttaggatctgagtttttgggaatgctcaaccgggaaaccggaggttttctgcgatatcgcctgccatgatgaagtcattcaagcaagccaggagatctgcatgatgtctgcacccaaaattacatttatcggcgctggttcgacgattttcgttaaaaatattcttggtgatgtgttccatcgtgaggcgctgaaaacggcgcatattgccctgatggatatcgatcccacccgcctggaagagtcgcacattgtggtgcgtaagctgatggattcagcaggggccagcggcaaaatcacctgccacacccaacagaaagaagccttacaggatgctgattttgtcgtggtggcatttcagattggcggttatgaaccttgcacggtgactgatttcgaggtctgtaagcggcatggtctggaacaaaccattgccgatacgctggggccgggcggcattatgcgtgcgctacgtaccattccgcacctgtggcagatttgcgaggacatgacggaagtctgccccgatgccaccatgctcaactacgttaacccaatggcgatgaatacctgggcgatgtatgcccgctatccgcatatcaagcaggtagggctgtgccattcggtgcagggaacggcggaagagctggcgcgtgacctcaatatcgatccggctacgctgcgttaccgttgcgcaggtatcaaccatatggcgttttacctggaactggagcgtaaaaccgcagacggtagctacgtgaatctctatcctgaattgctggcggcttatgaagcagggcaggcaccgaagccaaatattcatggtaatactcgctgccagaatattgtgcgttacgaaatgttcaaaaagctgggctacttcgtcacagaatcgtcagaacattttgctgagtacacaccgtggtttattaagccaggtcgtgaggatttgattgagcgttataaagtaccgctggatgagtacccgaaacgctgcgtcgagcagctggcgaactggcataaagagctggaggagtataaaaacgcctcccggattgatattaaaccgtcacgggaatatgccagcacaatcatgaacgctatctggactggcgagccgagtgtgatttatggcaatgtccgtaacgatggtttgattgataacctgccacaaggatgttgcgtggaagtggcctgtctggttgatgctaatggcattcagccgaccaaagccggtacgctaccttcgcatctggccgccctgatgcaaaccaacatcaacgtacagacgctgctgacagaagctattcttacggaaaatcgcgaccgtgtttaccacgccgcgatgatggacccgcatactgccgccgtgctgggcattgacgaaatatatgctcttgttgacgacctgattgccgcccacggcgactggctgccaggctggttgcaccgttaaggggtaatcgcttccggcgctctggtgattaagccaaagcgccgtagctggcggcaatgaaagcgggcgaggaatatcaccgtcgttaatgcgcccagtagtgcgcagaacatatcggattgcgtatcccacgggtcgccttgagtaccgagaaaatcatctgcgccctggcccattgccagcgctgcccaccactcgattaactcatacatcgcgcttatcgccagcgcgacacaacagaccagaaacgccaccattttacgcccgcgaacgtacatcccgcgcacgaggatctctcgtgccaccagtgcaggcaccagcccctggaaaaaatgccccagtttgtcatacggattacggctcaaccccagccattcctgcacctcaaaaccaacggggactttcgcgtaggtgtattgcccgccgaccatcaggatgatggcgtgaaagaaaatgagcgtatagagcagcggcgttaacggataacgtttagcggtggcaagcagtagcggcacgacaataatcaccggtgtcacttccatcagccaggtgagtttgtcatgggccgaaatgccggtataaatcaggattaacgttagcgccagtgcgccggtgttaagaattaacggcttgagtgtgcgggtcatggtgagttcgcaagtcagggaaaatactgactattgaccagtaagcgtgaaattacaatcgcaaaagaggtggcccagggggatcacctggcagcatgctgccaggcgctgggccgaagaggttacttagtgcagttcgcgcactgtttgttgacgatctgctggaagaagtcgttacctttgtcatcgaccaggataaacgccgggaaatcttctacttcgattttccagatagcttccatacccagctccggataagcgacgcattccagatgcttgatgctctgctgcgccagtaccgccgccggaccgccgatgctaccgaggtagaagccgccgtgtttatggcacgcgtcggtaacctgctggctgcggttacctttcgccagcatgatcatgctgccgccgtgggattgcagcagatccacgtaggagtccatacgacctgcggtggttgggccaagtgaacctgatggataaccggcaggcgttttcgccggacccgcgtagtagatcgggtgatctttgatgtactgcggcagttctttaccggcgtcaatcagctctttcagcttggcgtgtgcaatatcgcgacccacgataatggtgccggtgagcgacaagcgggtggataccggatattgcgaaagctgggcaaggatctctttcatcgggcggttaaggtcaactttcaccgcttcgccctcaccggccttgcgcagttcttgtggaatgtactggcctgggttgtgttccagtttttcgatccagataccttcgcggttgattttcgctttaatgttacggtcagcggagcaggagactcccatgcctaccgggcaggatgcgccgtgacgtggcagacggataacgcggatgtcgtgcgcgaagtatttaccgccaaactgcgcgccaagaccgagtttctgggcctcttccagcagttcctgttccagctggatatcgcggaacgcctgaccatgttcgttcccttccgtcggcagttcatcgtaatagtgagcgcttgctaacttgacggttttcaggttggtttccgcagacgtaccgccaatcacaaacgcgatatggtacggcgggcaggctgcagtaccgagggtacgcattttctcgacgaggaagtttttcagtttgccgggcgtcagcagggctttggtttcctggtagagatacgttttgttggcagagccgccgcctttagcgacacagaggaatttgtactcatcgccatctaccgcgtacaggtcgatttgcgcaggcaggttcgtgccggtgttgacctctttatacatgtccagcggcgcgttctgtgaatagcgcaggttatcttcgatataggtgttatagacgcctttcgacagcgcttcttcatcaccgccaccggtccacacgcgctgaccttttttaccgacgatgatcgcggtgccggtatcctggcaggtcggcagcacgcctttggcggcgatttcggagtttcttaagaattgcagcgccacgtacttgtcgttttcgctggcttctggatcgtgaagaatagccgcaacctgtttctggtgtgccgggcggagcatgaaagaagcatcgtgaaaggcttgctgcgccagcagggtcagggcttctggttccactttcaggatggtttcgccgtcgaagtcggcaacgctaacgtaatcggaagtgagtagatagtattcggtattgtctttccccatcgggaaaggtgcctggtagataaagggtttgtttgacatagcttccagcctgtaactctgtatttgttattcgaaaatggcgtgccgcgtagtcacgggcggcacgcaaagtgcatttataagaacccgtacatcgcggcgaagatccagccgaagacgcacgatacgctcacaccaatcaaccccggcagaataaagctgtggttgatgacgaagcgaccgatgtgggtggtgccggaacggtcaaactgaatcgctgccagatcgctcggataagtcggcaggatgtaataaccgtagcaagccggtgctgaagccacgatgtaagcggggtcaacgccgatcgccagcgcgaccggaacaatcgccgccagcgctgcagcctgagagtttacaaacttggaaaccagcagcagaacaatggcataggcccacggatactctttcaccatttcacccagtacgccctgaatttcagacatatgcgcaccgaacatggtttcagccatccatgcgataccgtacaccgccacgatggcgatcatacctgaacggaaaacttcgttttttgagatagacgcgggattggttttggtcaggataataatcagcgccccggtcagcagcataaacatctgaataaccagtaccatcgacagcggtttgccgccgaaggatggacgcaggtccgaatcagcaccaagaagggcgactacagcgattgccccgaggaagatccacattgccagccagttgcttttcggcagttttttatccagcagcgtcgcggtatcaccgtaaacatactcacggttttccggtacggagatgaatttttggaactcttcgtctttatccagatctttaccgcggaaccagctgaagataccgatcgccaggataccgattaacgtcgatggaatggtgattgccagcaggtcgaggaactcaagatggcgaccatcaaaggtgacattacccagcatcgcaaccaaagatacgaccgcaaccgacaccggactggcgataatccccatctgtgcaccgatagaacttgccgccatcggacgttccggacggatgttgttcttaatagcaacgtcgtagatgatcggcagaatggtgtaaaccacatgacccgtaccgcaaagaatggtcagcgtacaggtcacaaacggcgcgacaattgagacatatttcgggttgcgacgcagcagcttctcggcaatttgcagcatgacatcaagaccgcccgaagcttgcaaggtcgccgatgccgccaccaccgcaatgataaccagcatgacatcaaccggtggtttacctggctgaaggtggaagacgaagaccagaatgaccagaccgataccgcctaataaacccagcgcgatacccccctttctggcaccataaaacagacatatcagtattatgataagttggatagtaaataacatgtgtgaaccctcgcgataatcctatttaaatttttgctgaatagatcacagtcacgttctgttttgtatgaactgttttcagagcctgactaaatatccgtttggtcgttaccggcttgagcaaatacctcacagtgaatattggctgattaaagcagcggcgaatttatgcactgtgataagcggctttttcagagagaaagactctctggcgatgggtttatagtttgtacagcgcagatgttaatgttttgtttgctgttatcttattgatatttatcggtctgttttttgttctcagggcaggtatcattaggtttatagattaatctgatctacccatttgtgggtaaaaatacacataatgtgggtgacataatagttaattaacttttgttagcgttttgaaattaaaaacaccgttcatctgaagagatattaatttttagcgatgatgtagggataattatatttgatctggcacaagttttactgatgaacgatgtaacttgtgccaggggtattttgcattacggtaataattattacttacagataaccagcgatccgttattggcaatattgtttcagtagtgagtagtgttctgcctgaatacggtaacggtaaaccggacgccccgtgacgccataatggatactggtgaacaagatgtggcagttgaccagccagataaggtatttacggcaggaaacacgcgagatgttaacctcgttagccagctcgtcggttgaaaactcatagtcctgatgcgcgtcaatccactggcacagcgtgcgtaacgtctgcggcgttaagccttttggcaagcgacgaggatcctgctcgttggagctgctgccgtggattagctgatcaagctcggcctggtcataatactgatgtttttccagcgccattttcttttgccgccagccggtgagcgcctcttcaaagcgggaagcctggaagggtttgatcaggtaatccacaacaccgtaatgcagcgaatctttaatggttgcggcatcggcagcggaggagatgacaatcacatcacttttgcaacgcgcgttatgcaggacaggcagtaaatcgagcccgttctctttttgcatatagatatctagcaatatcaggtcgataggcgtatcgctattgaagataatctctttggctttctccagcgtcgaagccgttccacagcattgaaagcccgggatttgtgccacgtatcggcgattcagctccgcgaccattgcgtcgtcatcgataattaatacattgatcatctgttcgacctctccccgtcccagggtatctggacaaaaaattgtgtgaaaatcccgggttccgattccacggcgatgctgccgccgagattttctacctgttgtttgacaagtgctaaaccgacgcctcgctcgcttccttttgtcgagacacctttgtcaaaaatgtgatcgattttgtcgggtgcgatccccggtccatcatcgttaacttcgcagtgcagccagccgtgacggtagtgcaatgttacgctaatttcgccaccgggttccggtcctaatgcctccagcgcgttttctatcagatttcccaacgtggtaatcagcgtcgcgacctgatcctcactaccgctgtctggcagctggctttcactgtttaaaatcagcgtatggcctaaatcggtcgcacggttaatcttgctgattaaaaaaccagcgataaccggagatttgatcttacccagcagagagccaatctcttcctgatagttattggctgttttgagaatgtaatcttccaactgcttataactcttcagatgcaataatccgagaatcacatgcaatttattcataaattcgtgggatcgttcacgaagtgcgtcagcatagttgaccagaccgtcgagtcgctgcatcagtttacgtacttcagttttgtccctgaaggttgaaatggcaccgatgataacgccattactgcgcaccggaacggtgttgatcagtaatagtcggtccttaatcgtaatctcttcgtcgcggcgtggggttccgtcgcgtaacacttccgagacatctaccacctgtgaccacgagtggcttagcgtcgacagtttctcatcgtcctgcgacttacggtaattcagcaattcttgtgcggcatcgttgatcagcgtgacctcgccgcgatcgtccacggcaacgacgccttctttgatggactgcaacatggcctggcgttgctcaaacagtgtggagatttcgtagggttccaggccgaaaaggatttttttcagtacgttaaccagaatgcatgtgccgatcagtccgaccagcatgccaaatagtaccgaccagataatgctccagcgactgtcattgatctgttgggtcacgcggcttaactcaaggccgatcgccaccacgccaatttgtttatgattttcatcgtagatgggggtaaatacgcgtaaagcctgcgccagaaaaccgcgattgatagcgacattttcttcgccattcagcgcgttaaggatgtcatcacctttaaatggctgaccaatacgctgggcttcaggatgcgagtagcgaagactgtgcatatcggtaacgacaataaacagcagatcgttgcgtttgcgcacggcttccgcgatggcctggattccactctcctgcggttttttctgcaagccctgacggatttccggcgagtcggcgagggtacgcgctactgccagagccttgttagctagcccgtctcgcgtcatatcactgatttgcgagaagtaaatcagatgcaccaccaatagcaccgagaacagtaccgcgctgaccattaagatcacagtggtactcaatttcatcggacgtttgcgtaacatacggtagggcaatgaatgtctcatcagcttccttgtgtgacaaatttcttaagcattatctctgatgaggcgggtaattcaaagggagtaagaatgattgactatataggggaagagattctggcaacggaaactgccagtgctgtatgaagattccggggctatgcttatagcgataatcatactgatgagagagggaaggtcatggatcgggcgctactggacgggggttatcgctgttataccggcgaaaagatcgatgtctatttcaatactgcgatatgtcagcattctggcaattgcgtacgtggcaacggcaagttatttaatctcaaacgaaagccgtggatcatgccggatgaagtcgaggttgccactgtggttaaagtgattgatacgtgcccgagcggcgcgctgaaataccgtcataaataagcgagggtaaaatggaaatacgcgaaggccacaataaattttacattaatgacgaacaaggcaagcaaatcgctgaaattgtctttgtgccgaccggagagaatttagcgattatcgaacataccgatgtcgatgaaagcctgaaagggcaagggattggtaaacagctggttgcgaaagtcgtggaaaaaatgcgtcgggaaaaacgaaaaattatcccactatgcccatttgcgaaacacgaatttgataaaacacgggagtatgatgatattcgcagttgatgggagagtacagagtcacgatatttttcatgctctccgcggtgtgatgcaggagagcatctgaagggtagggggatgctcaaagaatggtcagagagagcgtttttttgtcccaagtcatcccctttactgagcaaaaaaaaagaatatctcctatatgagaatcatcattcggggttaataagttttgcgtccccagagcgttcaatattgataggagtcatattatggaaggtaaaaacaagttcaatacttatgttgtttcttttgattatccatcatcttattcctcagtgttcttaaggttaagatcattgatgtatgatatgaatttctcctctatcgtggctgatgaatatgggataccacgacaactgaatgaaaactccttcgcaataacgacatcgttagccgcaagtgaaatcgaagatttaatcaggctcaaatgcttagacttaccggatattgattttgacctcagcattatgacagttgatgactatttccgtcagttttacaagtagccaggaaggataagaagaacataaaaaatggcactattctctaaaatattaattttttatgtgattggtgtgaacatatcctttgtcattatctggtttatctcacatgagaaaacacatattcgtttacttagtgcatttctggtcggaataacctggccaatgagtctgcctgtggcattacttttttctctcttttaggagctgtagttgagtggacccgctggttatcttgaaacgaagcgtctctcctcaaaactggatttgcggaatgacgaacgaagcagtcgcctgactgcttcgttcattaaagtgaaatttatttcagtgggcgcatcgccgggaagagaataacgtcgcgaatagtatgactgtttgtaaacagcataatcattcggtcgataccaatacccagaccagcggttggcggcagaccatattccagcgcagtcacgtaatcttcgtcatagaacatggcttcgtcgtcacctgcagctttagcgttaacctgttcctggaaacgttcagcctgatcttctgcgtcgtttaattcgctaaaaccattaccaatttcacgaccaccgatgaagaattcaaaacggtcggtgatttccgggttaacatcattacggcgcgccagcggggacacttctgccggatattccgtaataaaggttggctgaatcagatgtgcttctgccacttcatcaaagatctccgtaacaatacgtcccagtccccagcttttctctaccgtaataccgatagattcagctaatgctttagcagcatcaaaattatccagatccgccatatcggtttctggacgatattttttgattgcttcgcgcatggtgagtttttcaaacggtttgccgaaatcaaacacatgctcgccataagtgactttagtggtacccagtacctcttgtgccagggtgcggaacagtgactccgtcagttcaatcaaatcatggtaatccgcatatgccatgtagagttccatcattgtgaactcaggattatggcgaacagaaataccttcattacggaagttacggttgatttcgaatacccgttcaaaaccgcctacaaccagacgtttcagatacagctccggcgcgatacgcaggtacatatctaaatccagagcgttatgatgggtaataaacgggcgagcagatgccccacctggaattacctgcatcatcggggtttctacttccataaagccgcgtgcgaccatgaactgacggatagcggccagaatttttgaacggacaacaaacgtttgacgggatttatcgttagcgatgaggtccagataacgttgacgataacggacttcctgatcctgcagaccatggaatttatctggtaaaggacgtagtgctttagtcagcaggcgcagctcagtacagtgaatggaaagctcacccgtttgcgtcttaaacagcgtaccgcgggcaccgataatgtcacccagatcccattttttaaactgatcgttataaacaccttctggcaggctatctcttgcaacgtacagttgaatacggccaccgacatcctgcaacgttacaaaggaggctttccccataatacgacgggtcatcattcggccagcaaccgagacttcaatgtttaaggattccagttcctggttatccttcgcatcaaactcttcgtgcaactggtcagaggtatggtcgcggcgaaaatcattgggaaacgccacaccttgctgacgtagtgccgccagtttttcgcggcgatttctcagttcatcgttaaaatcaatagcctcattggctccccgtgtttctcgttcagacattttggttcctctaaatccagctttcaatttagcgtagataaagagacagatcggtacactgtattatctgcctcgactattaataactcagtttatcttatcgaaactaacgtttacctcaagttgatatcactaataaataaccataaaaatggtttaaatgacttattaatctcgatttgctagtgtgataaactgaaagttaatttattcataaccaattgtttttacgacagttaatcgttgctctcctgtatcatattcgtcggcgtgctaaacagaaaacgggtagcaaaggccaataccacgatgatcgcgacacaagccaacgtccactctcccatctgagaaaagaatcgctggtaagcggcaattgccataccgctaatttgcgactctgtcgtctgctgtgccacgacgcctgccagccagttggcgactgcgcctgttgccagcatataaataccagttaatacgccagacattttcagacgcgtgatttgcgcaatcgccaccgggtcaataaagagttcagcaaagcccattagcgccagcccggatatcatcacgcccattgacgcttgaccgccagccgctgcatgtcgggcatcaaatgccagcaacataaagccacaagccatcagcagtaagccaaaggcaaacttcagccagacgcgcaatgctgaattgccgcggctttctggcgatgccagccaggccagaacaaccccagcgagcatcaccgcaatagcattcaccgactggaatagtgctgtaggtacttcaatattgaatgcctgacgattcacaaagcgatcgataaacaagctgatggtactgccgccctgttgtgccagtacccagaacaacgtcccgacaaacatcaacaatacaatttgccaaagagcacggcggtgttcggggaatttgatcatcatgcgggcaatgatttgtgcggcaatgaggcaaacgatcgccagcaaatatccggaccagtcgttctccagcagcagggtaaaaaatactggggctaaacagagcatcaccactaaccagctccatactggtaaggcaaatttgacgcttgtgagcgcttttttatccatactacgcgtggactggaaatgacgatgaccacttaagaaaatcaacaaaccgataaacatgccgcctcccgcaagggcaaagccaacatgccatccataccactgagcagccaggccgcaggcgatgggcgcggcgatagaaccgatattgcccgcagcatacagcagcgaaaaaccgccatcacgtcgatgatcgttctcgtcgtagagctcgccaagcaaacagctgatgtttgatttgaataaaccgtagccacaaataatgattgccagcgccagatacaggctaaaggttgaatttgtatcaatgcccagcaccacatggccaagggtcattaacagcgcgccggcaatcactgcagtgcggttgccgagcaggcggtcggcaagccagccgccgagaataggggtaacgtaaaccagagaagcatatgcgctgaacaggctgatggcatggttatcatcaaaaccaagctgatgggtgagatagagaatgagtaaggcacgcatgccgtaaaaactgaagtactcccagatttggatcgccacgatatagtatatcgcgcgcggctgtgagggtgttttcatgtgttctccttatgagcaaaaaagggaagtggcaagccacttcccttgtacgagctaattattttttgctttcttctttcaataccttaacggtatagcggccatcagcctgacggtatgcaccgtgaatatcggtttcaaagcccggatagtgagcgccgatttcacacagcatctgcaggaactccagaaccggacggctttcttcggtgatcatttcacccggcattaccagaggaactcccggcggatacggaaggatcatattggcgttaatacgacctaccatttcgtcgaggtaaacttcttcggtcataccgggcagctctttctggaacgcagcatacggagtcattaccatagtcggcagaacttcaaatgcgcgatacatcagatccggcagattgtggtgaacaatcagtttgtggatattctgagccagttcctgaatacgcatgttttcatagaattcaggatcttcacgatacagagacggcagcatgtttttcacacgcaggttcagatcgaacgcacgtttgaagtcagtcagagcacgcagcaggctcagtgctttggtcttatcgataccgatgctgaacaggaacagcaggttatacggaccggttttctcaacaacgatgccatgttcgtcgaggtatttcgccacgatgctggccggaataccaaagtcgctcatggtgccgtctttttccatccccggagtcagcagggtgactttgatcgggtcaagatacatgtgctcgttatcgatgtttttgaagccgtgccaggtgctgtcagaacgcagcggccagcattcagtcgtatcgatatgatccggctgccatacatcaaagaaccagccatcagattccgttctcagacgtttgatctctttacggaatttgatcgcacgttcaatggaaccattgatcagacgtttacctgcattgcctttcatcatcgccgcagcggtttcagtggacgccacgataccgtagtgcggagaggtggtggtgtgcatcatgtaggcttcgttaaaggtttcttcgtttacgtcacctttaacgtggatcatggaagcctgagagaacgccgccagcagtttgtgagtagactgggtttcgtaaatcactttcccttctacacggccaccgctcataccgcatttaccttcgtaaatcggtgagaagttggtgtaaggcacccacgcggagtcaaagtggatggatttcacatccagtgttttcttgatgaagtcggtgttgtacagcagaccatcataggtagagttggtaattacagcatgtaccggccaggttgcgtttggtgtttctttcacgcgcttagcaatggtagcgtgctggaattcactctgtgggataccaccaagaataccgtaagcgttacgggtcgggcggaaatagattggcgtaacatcgctcatcatcatcaggtgggtcagcgatttgtggcagttacggtcaatcagaatggtgctgcctgccggagcagagtacataccaacaattttgttcgcagtggaagtaccgttggtcaccatgtagctgcggtctgcgttaaagacgcgagcgatatactgttctgcttctttgtgtggaccactgtgatccagcagagaacccaattcagatactgaaatggaaatatcagatttcatggtgttcggaccaaagaaatcatagaacaggctacctaccgggcttttctggaatgcagtaccacccatgtgaccaggagtacagaaagtatatttaccttcacgaacatatttaaacagtgctttggtcagcggaggcagaatagtgttgatatattcgtcagtggtctgcttgatcttgttagcaatatcatcagcagcacccagcgcatattcaaagaagctaatctgtaaacgcaggtcattcaggcttacatcgagagtggaatacgtattagcgaacgcgtacaacggcaggttctcgttcattttgctaatttcttcgcacagctcgagattatatttatcccagtcaaaaataacgccgcacagacgcgcattgttttcgatcagttttaataagtcgtcacggtcgttcgggtaaacaatctggaagttcagacgttcaagcgcgcgatgaagttcacggatgggttcttctttaaaataaacccccatgtgattcaatattgcaataacgttcatagtcatatctccaggtaaaaaaggcccctcccaacacatgggacaaaatgaaaggaggagcctcggaaaatacttttaattaatgtgcgttagacgctgtgtggttatccattgagtggctctggcgctcgtgcattttgcgagcgtagaacatcaggataatcaggctgacgatgaaggtacctgccagctcgaaggagcttgcgcccatcagcgcgatgaagcagaacacgcaacccagtacagagcagatcaggctgacaaagttgcggatgttaacgccttcaaaacgaatcaggtcaacgcaagagtagaagtacggcagcatagtcagcagtactgcgataccggtcagttcaccgaacaggtcagatgctttaccaccggcagagttcatcagagtgatgaggatcatcagggcagtcattttcactgcagccagcagcagaccttttttcggaataccgttgttgtcgacttcaccataaactttcgggaagttaccgtcgttagcggcacgtacacctgcctggcctaccaacatcatccaggagcccagagaagtcagacacgcaaaggcggtgaatgcagaaaccagtggcgcagcccagttaccgaggatagttgaagcactgattgcaaacggagcaccggaagccgccattacagaagacggatacataccggaaagcacctgagtcgcagcgatgtaaacaatacctgctaaaccagtacccagcatggttgccagcggaacggtacgtttcgggtttttaaccataccagtacttactgctgcggattcaacacccacgaaggcccacaggcagagcagaatacttttaatgatcgcatgaccatcagtggtatccgcagtattccagttagctgcataagttgctgcatcaaaccaatgccagccaacaatagcagtcatcaccacaggaataagaaccagcaccagaccaatagtggttaaacggcttacccaggtaccgccgagcatatttacaaaggtaaatacccagacgatagcaatacaggcgatacccgccggaacaggatcatttaatactgggaagaaggtggaaagataagatacagcggtaataccaattgccaggttaccaatccagttagcatggtaataaagaacacctgtctgaaaaccaaatgcaggagaaatttctccggcatacgcaattgggccaccttgttgcgggttttttgttgccagtcgggcatatacatatgccagcgacattgcaccaataatagagataatccaaccccagatagcaataccaccgatacttgctaggttcgcaggtaataatgcaataccgctccccatcatattaccggcaacaacaccggtacaggcaaatagcccgatcttcttggcagaactcatgctcttctcctaatttcatttttgaatttggagtccgggtcatgatgtataactatttcctgaccagaccaaactggcgctaagattactcacgaaaaaaggattaatcctaaagattaggtgaaataacacaaaagtttctgtaagtgagaacttgaggttttttattaacacatcaggatcgcaagttgatatcatgaaaagataaacattcaatgtttacaatatgttatgtgacattttctggttaaatttatgtaataaaaattatgcggcaaataaattgccgcaacatattataccaacgggaacatacaaaaactcaacaacaaatattcccgagcatgaatcaacccgggagttacttattctgaagcgagaaatttgtcgagataaggtacaacataaggaacagaagtctggaatataccattttcaatccagtaaagggtgtttgcccctgggcgtaaattaaaggcggtgagatatgcatcagctgcttcccggttcatccccttcatttcataaaccttgccaagcaacacataatttagccaggacatttcaagatcaatgccggtatttatcgcctgataagactcatctgttttaccttttaccagggcactgaccgcttttatttgatatataatggacaggttgttcaattccggcagtgtaacaatgttatctatttctgtgttcagtgctgctaattgtttttcgtctaaaggatgttgagaatggcgcacgatatcaactaatgctttttctgctctcgcgtaggtaaattctggggatgattgaacaatctcacctaataattcactggcacgatccaatgatttatcatcaccatgcagtaaataatcatgtgcctgataaaaattagttaataacgcaccacgatgcggcaaaatttgctggagcatctcctgcattcgttgtggccacggttggtttaacgcttttgataaactctggagcaaatcattttgaatcgccagctgattaccgttagtgatgacataacgtttatccagcatggttgaaccatctgcattgtctaccaattttaccgacataaagcattgttgagcacggtattggcgctgattaacaaacgcaatagataatgttttaccggaactgctcggttcatcaatgttgtagttgattttgtcatgcaccataaaggtggagaaggtgttaagtgatgtcgccaccaaatcacccacgcctatcgcgtaagagagctgatacggagaactccagctgttacaactcttattaaccatattaatgtcaatatcgcgtggattgagcaaaatgcgcgatttactcataggaagacgtgtttcaagacttgaaaacgctaccagtgtgacacagatacctaacgacaacaggaaaaaaaaccatacccaaaaggtagtgaatcgtttgcttttaactggggattgttcaggtggcgttgtggtgttttgaatgttaagactgtgggagggagaatctgtggcaggaaccgcctctggtatagggggaggcgaagatagcattatttcctctccctcttcttcgctgtaccagataaccggcaccattaatttatagccgcgctttggtacagtagcgatatagacaggactatcttcatcattatcttttaatgacttacgtagttctgagatactctgcgtcacaacgtgattggtgacaatacttctcttccagacattatcgataagttcatccctgctaagtacttcgccactgtgttgagcaaagaaaaccagaagatcgattaatctcggctcaagggtaagttgacgcccattgcggctaatttggtttatggacggagtaacaagccattcgccaacgcgaactacaggttgttgcataatagaaactcattcgaaaagggaatgatgcaatgataattgccataacctattttttccatctatagatgggtttatttacatattattggtgaatgtaggacgttatttttacccgccataaacttcttgattacatagtattacgaaaggattttactgagaaccagaagtaattttccttaccatcaaaattcatcatctttgccaaagaaaaatgttcagaaaataatccatgaaaaattgtccggagcgcttactattttaatggattgttagtctttgcatgagcaaacggactgatacatttctctttgttctcattcagaaaatctcatcagttggcgttctgcccgatgttgtgctttatgggtgcgttacgctcctgatgacgtcatttgacgttcaacagcatcacggggccgcacgacatttcacgtcagtcagcgctatagctcagaaacaaattttcccgaattgggatatgcccgcaaattgctggtgatgtggggagaatctggttgagttcggtagaattgatttggcggcaggacgcttaaatcgtggcgtcctgaaacgaaaaacggacctccgtggaggtccgtttatatgaatttggtgccggactcggaatcgaagaatgcttctatcatgttgatattaatttattttgtttggtttggtgaaatatgtaccctcttttgtacccgcagtcccttttgatatcgaaagggaatcaaactcggggtcaggctgagagcacagaaggaaagtgcctggctattatatcgttaattctgccaatcagctccagccttttgaaagtgatgtgtgcagatcccttcttaaagtatttaatgatgaacatctcatcttcatagcgtcctttaccctgaacggactgtatgtggtcatccagattaatggtgatattccctcggttgtcggggatcggtttaccgctgagcagatgcaacattctttccaggtcagccaggcgatctgcctgcattccactgataagatgaaatccccactggtcccatctcaccagattgttgacgataattttactgccaaatttacagggtgagttggttttgtaatcccagctcagccctttgaagacgttgatcactccccgttcaaacacttcatctttgttctggtgcagttgttcaaatgtgctcagaatgttcgcttcgctgatttccggaaaattatcatattccagtgacctggacctgactgaggtggagcagataacgtccgtattctcgttgaccacttccggacgggagactgtgatttcagacataatcgatattcctttttgcagataaatgaaaacgccagccgtgttcaggctggcgtcagtggaatgaagtctggtgagtgagatgatgagtgagactcaccggttctggtgctgaagctgcagttggcgcagggtacggatatcctctctggcctgttcgatacagggcaacagtgctgctgaatccgttttatcctcattgttgtcaaagataattcccgattcgcagtcgatattgtcctgcagccacgcaatcagaatatccagtgcggtttccgtggttaatgatttcatgttgttcctggttaccagttgaaagtgggtaaacccggcaggcattcagcgctggcatccagatgaatgagactgacgccataacgtcgggtaagtgtgataaccagacgacggaacgtttttgacagccccaggcgtttaagccgcagaaccggatatgaccacgcatcggtacgtaacagatatccgctacctgtgaaatgaatccattctgattcaccaacgtcactggtctgatgcgacagcgagtacagccaggcgttatccttttccgtgatatgtgcggtactgcagcgtatgccggcaagggttgcaaacggtggtagtgtgcaggttgactgttggtcggattcctccaccacgcggagtgaataaccgttttcagcgaccttgttaatcagttcagtgagattaacaccatcgacgtcaacgacaattcgccccatgttcagtgcctgcacattaattctgtcggcttccagcatcagggaaagtttcatcgtttctccggatgcttacccagggtaatgttatttaccgttctgtaattgtcgcgggtcatcaggccggtcgcccggcgagcccggaggatatcaatactgtttattaactgagagcggggacaagtgctgaatcccggctggtcggtacgcaccagcgcgtatttttccacgagaaaattcaccgcatcacacagtgaaatgccagcttcaatatgctgctcaatcacacgttcatcggcgaacggtgtgtcattcagtgtaaggccgtaatgctggcccagtagtcgggagagcagagtctgccagatggtgacgggagacgggcagctcgatgcctcccgtacgtgtgtatcgggtaatgttttcatactgaaggttttcctgatatgcagagatgaaaaatggaaaagtggcgtggtgaaagcaccaggccggagcagaaggttattccggtggtttactttttcgtttcgggcgtcggataaacagccagataaacgtaaccaccgctaccgagagtgtcagctttgcaggtcagaccttttgcatacagcgtgacggtatgctgatggcggggattcagttcaccgctggtgagcatgagttccagttgtttcatcagcagcggaaaggcctggtccaggtggtacgcatctgcatcgctgaacaggcctctgataccggcgcggtcggcaaggtaatgcaggcggttaccctcctgcaccagacgtgccccgaaacagggcgtcacggtgcagggcagcccccaccaggggcggtcgtgattgtcgtcgggaagcattgtcccggagagtgcgtctgacacgataaaatcctcacagaaaatcggttaagaatggtttaacgatgacaggtcagccggcgcgcagaccgccttcggtaaaggtgtattcgtttatgagcagggcctcatccacagcggcgtctgagctcagccagtcgtactcgttttccgggtgacggaacatcagttcagggtgacgctcatcagccggacatacgggccaaaactgtccttacgacgttcagcaaacacggccagcacaccgggaatatcctgcacttcacgaccggtatacgcttcagtgctgccgtgccagcggtatttgccggtacagaacgggaaaagacgggatgtcggatgttgttggtgaatacgcatggcttcaccacgagtgataattttcataatgggatacctctgaagacagaagataaaagtgaaaacaggtgtgatgtggttgtgacgggttaaagcagaccatgttcggcaaaggagaaaacctggttgccaccgactatcagatggtccggcacccggatatccaccaggcccagtgcctgtaccagacgttcggtgataagccggtctgccttactgggtgtgacttcaccggacgggtgattgtgcgccagtaccacggcagcggcattgtggtacagggcgcgtttaatcacttcccggggatggacttccgtgcggttgatggtgccggtgaagagggtttcaccggcaatcagctgattctggttattcagatacagcacccggaactcttcacgctccagtcccgccatgttcagaatcagccattcccgtgccgcacgggtggaggtgaaggccacaccgggttcatgaagatggcggtccagggttttcagagcccgcagaatgagactgcgctcgccgggcgtcatttctccgggcagaaaggaaagctgctgcattgtccctgcctccattcagtcgatgatgcgcataatggcgctgcattccggatgctgcagggcgtaatcccgcagccggtaataatggaccgtcatggcataacactccgtacgacaggcgtgatgactgtacgtcatcagacaggcagcaatgccagcggcttccgggctcatttcagcgcggttgccgttcatggcattgaacagtacccatgtttcgtcatcatcgtcatccggttcggggccataaatgccccgccgttgttcagggtgtacagattccagataccaccgcagtagtcttcgcacagacggtccatccagccgaaaacacggggctccagggccacccactgtggaatgaggccaaaatgctgcggccagaagctgatgcgctgttcatcagggactatggtggcaaccaactgaggctggtcattccctgatgcagcggttacggaaacagaagatgtggtggaattatgtgaaatggttttcatgaaatgactccttaaaggacaaataaatgcgtggttttcagggtaatggctgaatcagcgcaggctctccagcagggtttccgccatcacccacaatgcgcggttgagcttaatgtcagtgtcaatgctgtgaatggcacgggtatggatacgttttcctttagcgctgcgacctgaaattccgcctttcagcatattctcctgaatggtctgataagcactccacaggtccttaccgtaatcctcccggcgtcgtggcgtcagaatgtcggcggtggtgacgggctgatgttcgtcaccataacggtaagtcagtgccgcctgtgccagcgcctggcgtgccggtggcggcagaatcagcgactgcatggcatcacgcttttcctcaatccggtcaaacacgcccaccacctcgtaagccccttcaatgactctgtccaccacatttccccggtgcggaacacgcacttcccccagagactgaccacagacgcatccgttctggcagacgaacctgaagtaacccggcagcatctggtagctggaggtaccgtcatgagagttgagcagaataatttcagggacatgttctccgtttatctctccggcccgccgcagacgcagcatgtgttttgtgtatccccggcggcccgggtcgcgcacacgggtctggcaggcgaaaaagggctgaaaaccttcccgctgcaggctttccagtacggtgatagtggggatgtacgtatagttctggcttcgggacgtgtgtttatcttccccgaaaatccccggcacatggtgcatcagctcttcatgtgtcagcggacggtcacggcgtatctggttcgcataaccaaaacgactggctagtcgcataatttgctccttatcggtggttaagatttactggtgtaataaatgaaaaagccacgtctcccggagaagacgcggcctgatgggtgaaatgaatgacgtttattgtctgagaagaccgtcactggcgagccgcgtattaagcacctttccggcatcgggttcagaattccggcagcgccagcgtcgctgaccttccgcgttgcggataacccgacggaaatgcattcccgggtcatcctggataaacacattgcggtaagcggttatgacagcaaccgcctgcccgtatgagaaagatccttcagccaggacatactctgtgtaacccggcatatctgttttctcctgataaataaaaagcctctgccacgcgttgtgacagaggctgaagcatgaaactgacttcagggatcagttaacgttttttccggaaacggtaatcagcagtggatggtagtcctggggattgaaaaccgataacggcagactgacacgatggccgttactttcttcagttgctttaatgatttcggttgtggcgacattttccacgcactccgtttccagaaatgcgtctgtggttcgcgtggcattactgtcaccaaaagcttccgtttccatttttctggtcaccagcgtctgaccatatttgtctttgagttgcagagtgatggtgagggggccaaatccttcatcgtttccgccattatccagccggaactggtaagcacaaatatttcccgggagccatattgtatctgtattgcgtatactgatataacgttgatcctgtgcccggagtggggcagaccacgttaaccccagaatgaaggcggtaatcatgcaggttttgaacaggtgaatcatggtatttacctctctgagtcatgacgatgacactgacaaatcaggtgataaagcgtaaaaggcgcagaatagccgttatgccggtaactccggggggaatgcttcttccagtcggttaaccatattgccgagatgggatgcatcatattccatgacggggcgttgcctgatgatactgaccaccagtggtttgattaacatattggtcgcggcccgttgttgtataccggcggcgaaaatgatctccagagcattctgatcgataacacgggccagattctcgttcagattttcaatctcatgtccggtcagcaggaaactgccggcaagccatgtcacctgctcctgaatcattgccagaattttgacgcgatcttcttcaaccagcgctccggctatttttcctgatacagcggaggcaatcattccccccagaacaccgccaaccacacgccctgtcagtgcaccaaatggtcccagtggactgaacagtatcccgcccgccactgacccgacagctccacctgccacaccggaagatgccacggcaagattcctgatgaactgcgcaccggagatccgtccccgcaacattttgatcatgtcagggccggttgtgacagctaccagtgccagagatgtcaccagcgtacccttcattactttgttcagggcactgatatttcctgcaccgttccccttctgaagagccagtcggacagtcgggctggcagtcgaaaaatcaatgtgcttcagcataccctgaacaacactgagccggtggagttgctgggttgtgacgtagacagccagtgtgcgggtgaaggtttttcctgcctggacagcagctgtctgcagggcagcatcgcgatcgccggtgctgagccagaagaccgatgccgtcagggcaaaactgatccctccggccgccagactgacaaccgaaccctcggcaatatcataagtggccgattcgatggtcccgaaccgggtgatattacgggcctgagtataagtcagatgtccccgacgaatcagccgggacgcttctgcgggatcggttacaccgggtactttaccttcgcggatcttattcctcatggtttcaacagcgccggcatactgatcacgggggacttccagttgcatggggccattatttcccatgtaacgatactgtccgttttgtccgtcgaatgccgcaccgacgctacgggctgcagttgaacaatatttcgtctggatttctgttccgctgaccagtctgtctgctccatttctggcattattatcaccgaggatccgtgcgtttttcagacggactctgtcgacaatatggtttccccgttcagcggcaaacccatgtccctgccctccggaagcaaacattttctcatttgtactccaggtttccggcagtttcatgagaatcagaccattcgccgttgcatcggaaataaagctgttgtaagggcgttcataaatttcctgacacagtgtttctgtttcgcgacaaagagaggagcagtaccattccggatccggcttatgattttccggggcatgatgtacttctgtcagcccgcaggaggcacagatacgaagctcatccacgtgatggaatgatacaaaacggcgaccttctgaaaagggataccagtcaccgccgtccaggcaacgatcgagaaaatcgtcattcgcttccggtgataaattcaggcggttccggaagagcgttttcagttcatcaggtgtgaatgacaggttctctttcaactgttcgttaaaccctgccatgtttctttcataccaggcattgttcagtaaccagtttccgtctgacagttcaaattccctcagctctccccgggaaatccgttgagaaatgagcgtcagccagatgcgctccgtcagtgagtcaggaaggctgtaatcgttttgcaaactggtcagccacgatttactgttgagcaccggttgttcttccagtgtctggctgatggcacaggtcagttttttcagcgcctggatctggctggccgcccatagcagcgtcactaatgcagccagccagtacaacaacccgccccaccacatcagtgacggtgaaatatcgtattgtaacgcgatcaatggtgcgcatgcagaacacgccataaggcaaaaggcagtataaaaacagcagtaatacccgttaatttccttgctgatatcttctggtgtgatcccgttctgctgaatgtttttgatctgcaggggaacagccagcagaccaccggcgagagcggtggtcagaataaatttcacagagtcaaaggtgtgagcctccagcgcgatatgtttaccatcaagtccccacatgaagctgatgatcattccggcaatcgtcagaaatacgcctgccagccagcgaatatggaacaaccgggttatgcgttcggtgatatagccagccagtaaggccgggccgaacagacacagcaatatgagccctgccagcgcagacgccgtgctgattaatgctctgaacaaaaggcgaagaatggcaaatcctgcgatcagcaggatcagcgcgccgactatctgtaacatagtcactccgtgatgaatatcatgttattgttaatgcgtaagcttccggggaactcatattgacgcgtttttcaggcgcgcgtcatcggcggcgcatacgaacgatcgtggtttgataacggttgatttattttgttgcacaggggcgatcgccaggcaggtaccggaggcgggctctgaagtactgagtagggtgatcgcgtcaggccgcgaagtactgactcggggattaatagcaggtgatgagtaagcgtacagcgagggccgtattgacggggatgtgttattcagctggcagtgctatgcgccacggaagcagttcgctgacccggttgaccggccagtctgctatgacgccaagcacatggcgaaggtagctttctggatccacgtcattcagtttgcacgtcccgatcaggctgtacagtagcgctccccgctcaccaccatggtcagagccgaagaacaggaagtttttacgacccagactgaccgcccgcaaggcattttcagcgatgttgttgtcgatttccacccagccattactgcagtacacgttcagggccttccactgtttcagtaggtatgcgaacgcttttgccgtatccgagtgacgcgacagtgttttcatctgttgctgtatccggtcatacagtgactgcatcagtggcgcggctcttgcttttcttgccgccagacgctgttctgctgaacatccccggacttctgcctcgatggtatacagttcaccgatacgctgcagggcttccgtggtgatgtcggttggcactcttgcatgcacatcgtggatttttctccgggcatgggccatacacgcagcttccgttattctgccggattcgtataacgcccggtaaccaccgtaagcatctgcctgaagcacaccgctgtaaccggctaggtgattctgtggatggatacctttccggtccgggctgtacgcgaaccagaccgccgggggcatctgtgaaccggcgttacggtcatcacggacatagacccacagccgggcagttcttgttttaccactgcccggctccagcagttcagcaacggcaccggtccagcgacccagtgtggcacggctcagctccacgccctgacgacggtatatttctgactggcggtataactgtcaacgacggatgaaaagtggctcttccgcaacctgggtggagattttcatgccagtggactcattaccctctgcctgagtagttcaaatcctgctcgaccatacatctggcgtttcagcatcttcttcaggcgatttacatgaccttcgacaacaccattactccagcgactactgattgcctcacatatagctgcagcatcagcttccatccccgccgccacgcgccgaaattctgctgaaccgctttcgtggactcgagtgaaccaactgcttagctgtgatttattttgggttttcagaatacggtagaactcgagtgccagttgctgcgctattttcagctcaggttctttttcacacatcagactaataaatcgggaagcataattttcttcatccctggttattctccagggcatcaaccagcggcttacccgggagactgaaggaagtctgacggcagtagtaaccggtgggttccagcctttacgccatttggcaaccgcatccctgacgatggtttcactgcctgtaaatccccgggccaccatttcccgccatatccggctggcgttataattaccactttctcgttgctcttttaaccactccctccatggtgtcagcgaaaaacgaaaccgctgttgaaatccctggaaagctggttgcggaaaagatgaagaccctgtcgcgacactcagagttggcgaaggcgttcgcgtacgcacttaaccagtggccggcactgacgtactatgcgaacgatggctgggtggaaatcgacaacaacatcgctgaaaatgccttacggggagtggccgtaggccggaaaaactggctctgtgtgtcacgaaggagaactgatagcggcaatatgaaaattgcagcataagttatccatgctctgaggtgggtggaggtgggccctccggtcagggtttgcaggaacactgaccaaacgacccggtgctgcttcattctaaggaatgtagtggtgagcgactcgggaaaaggcagagatctactgtcacgtggggttcgggaagctgaacgaaagtaaactgtccgatgaagcatcgaaatcttagatgatgtcaaaatggggccgtacagccgtcctctgataagcgcagaagacacctgcttactgactgcgcggcatccggtgttaaggcagcaggatcccgggccagaccatctcagggaacgtgagaacctgtttccggcacgtatcgggaaacaggggcggacccattcgtagtagtgatgaaagatctgtaatgggtctggagcgaagggatggggatcacattcattgcaaaagacacaacccataaggggatgatgtaactgatgcaacgaaaatcattcgaaataccaaaagcactggtctgggcatcatatctggatgtgcgtcgcaacaagggagcccccggatgcgacggacagactttgaaaatgttcgaccagcaacgtgatggcaatctatacaagatctggaaccggctatgttcgggaacatggtttccgccacctgtgctggaaaaacggatcccgaagccgaatggcaaggagcgcattctggggatcccaacagtatccgatcgaattgctcagggagcgataaaactttttatggaagaaaagcttgacccgattttccatgctgattcttatggttaccgaccaggcaaatcagctcatgacgctctgaaacaatgtgccatccggtgctggcgttatagctggatactggaagtggacatcagtgcgtttttcgaccatgtgagacatgatctggtgctcaaagcactggaacaccacgggatgcctaaatgggtcatcctgtactgtcgacgctggatggaagcaccaatgcagagttgtgaaaatggagaattaataacccgaacacgaggcactccgcagggcggggtcattagtccgctacttgctaacttgttccttcactatgcatttgatttgtggatggaaagagaatatcggggggtaccgtttgagaggtacgctgatgatattgtagtacattgttcacgaatgagtgatgcaacaaggctgaagaacaggttatcggagcgcttctcggaagtcgggctggtcctgaatgcagggaaaacgaatatcgcctacattgacacgtttaaaaggagaaacgtcgcaacgagtttcacctttctcggatatgacttcaaagtgcgtacgctgaagaatttcaaaggcgaactgtaccgaaaatgcatgccgggtgcgtcaaatgcagcaatgcgcaaaataacagaaacaatcaagaagtggcgtatacatcgctcaacagctgagagtttgctggattttgcgaggcgctacaatgcgatagtgagaggctggatcgagtactacggaaagttctggtccagaaatttcaactatcgactgtggagtgcaatgcagccacgtctgctcaagtggatgcagtctaaatacagactttcgaaccggagggctcagcgaaagctgacgctggtaaggaaggagtatccgaagctatttgtccactggtatttactacgtgcatcgaatgagtgatcaagagccgtatgacgcgagagtgtcacgtacggttccgtgagcagccggggagtgaaattctctccggctgactcgactcgcgggttccgacagcggtggcgaacatgcggtggtgttgtactcgctgatcggcacatgccgtctgaacaatgtagagccagaaaaatggctgcgttacgttattgagcatctccaggactggccggcaaaccgggtacgcgatctgttgccctggaaagttgatctgacctctcagtaaatatcaatacggttctggcgagccgcttacgtgcagcagtcttatccggcagtttaaaggggagggcggagaccaatgaggcactggagcagattcagtgcagaggtgacctgctttatcaaacttaattgtgacaaaatgggtaagcgtaaactgaccgccgtatgtagccatcagacgaaaattggtaacttagacgcccatctgatatagacggacatctaagtatggaattacaggactggcgaaaagaacctcgtaaaaactattcgaatgaattcaaacttcgtatggtggaactggcatcacaacctggagcttgtgttgcacagattgcacgtgaaaatggcgtcaatgataatgttattttcaaatggctcaggctctggcagaacgaagggcgtgtttcgcggcgtcttccggtaacgacctcttctgacactggcgttgaattattacctgtagaaataacgccggatgagcagaaaaaacctgtggcggccattgcgccgtctttatccacttccactcagaccagagtcagtgccagttcctgtaaggtggagttccgtcacggtaacataacgctggaaaatccatcgccagagctgctcacggtgctgatccgcgaactgagcgggaggggaagatgatttcactcccatcaggtacccgtatctggctcgttgccggcgttaccgatatgcgtaaatccttcaacggactgggagaacaggtacaacatgtgctgaatgataatcccttctccggccacctgtttatcttccgtggccgacggggtgacaccgttaaaattctttgggctgatgctgatggtctgtgcctgttcaccaaacgcctggaagaaggccagtttatctggcctgcggtacgtgacggcaaggtatccattacccgttcgcaactggtaatgctcctcgataagctggactggcgtcagccaaaaacatcccgccttaactcactgacaatgttgtaaaaaactcctgaccgcattataaaaacggtcatgagtcagaaatacctcattcgcatcgcagagctggaaaggttgctctctgagcaggctgaagccctccgtcagaaagaccaacaactgagtctggttgaagagacggaggccttcctgcgttctgtgctggcacgtgccgaagaaaagatcgaagaagatgaacgggaaatagaacatctgcgggctcagatagaaaaactgcgccggatgctgttcggtacccgttctgaaaaactgcgtcgtgaagttgaacaggctgaggcccagctgaagcaacgcgaacaggctgaggcccagctgaagcaacgcgaacaggacagcgatcgttacagtgggcgagaggatgacccgcaggttccccgccagttgcgacagtcacgccatcgtcgtccgttaccggagcatctgccccgcgaaataaaccgcctggagcctgaagaaagctgttgcccggagtgtggcggtgagctggattatctgggggaagtcagtgcagaacaactggaactggtgagcagcgccctaaaagtgatccgcacagaacgggtaaaaaaagcctgtacaaaatgtgactgcatcgttgaagcaccggcaccatcccgtccgatagagcgtggtatcgcgggcccggggttacttgcccgcgtgttaacgggaaaatactgcgaacatctgccactgtatcgtcagagtgaaatctttgcccgccagggtgtcgaactgagccgtgccttactctccaactgggttgatgcgtgctgccagttaatgactccgctgaatgatgccctgtacagttatgtgatgaacacccgcaaggttcacactgatgacacaccagtaaaagtactggcaccgggcaggaagaaggcgaaaacaggatatatctggacgtatgtccgggatgaccgaaatgccggttcgccagaacctccggcggtctggttcgcctactcaccggaccatcagggtaaacatccggagcaacaccttcgtcccttccggggtatcctgcaggcagatgcgttcgcaggttacgatcggctgttcagtgccgaacgtgaaagcggcgcgttgacggaagcaggatgctgggctcatgcacggcgcaaaatccacgatgtatatatcagtaccaaaagcgcgacggcggaagaagcactgaaactaatcggtgaactgtacgccattgagcacgaaatacgcgggttgccggtgtctgaacgcctggcggtcaggcaaatgcagagtaaaccgctactgacttccctgtataagctgatgcaggagaaagaacacacgttatcgaaaaaatgccgtctgagagatgcgttccggtatatcaggaagcactggattgcgttgtgcaacttctgtgatgacggtctggcggaggcggacaataacacagcggaaagagcgcttcgtgcagtctgtctcggaaagaaaaattacgtgctcttcggtagcgatcacggcggcgagcgtggtgcactgctgtacgggctgatcggcacctgccgtctgaacggtatcgatccggaagcgtatctgcgccatattctgagcgtactgccggaatggccttccaaccgagttggcgaactcctgccatggaacgtagtactcaccaataaataagcgtcaatacggtgctccgttgacgcttaccaaaatggcgattgagaaggtgcaattgacttatccggattcggtcgtggcgaggtggtgcccctgcattctgctaaccgggttatgagccaggagtcagcgatagacaaagggacttatctgaccgggcccccggaaaaatggcgggagagaatgataccttcctgctgacgagaccggactttgagatgacgagcgatagtgcggcagtgatgtacagcctgatcggtagctgcaaaacttaacggaatcgagccggaaacgtggctacgccacgtgatcagtgtaatcaacacctggcctgccaaccgcatgaaagagttgttgccctggaacgtcactctctctgtaaactaatttttaccccacgtccttcacggtgcgcttacactctggacaagtatgtaaatgataagttaaaaataatccgtgcatttcctgtgacgatattagttgttggtaacgaaatctcattagcggatcggaaatgcacttaacctaatacgttgccactgttccgccaggagttgcagtggcaacgtattctaccgtcagtgatagcgttttgttattatcagaactgatagttcagcgacatccagtaatttcgctcaggtatcacatatcctgttgttgatgatcccgtctggaagtaatcaccggcatacagcgtactcttaccggcactgtacaggctcacgtcactgtaatccttgttgagcaggttattcaccgcagcattcagcgtcagggcatccgtcatcttccacgacagacctgcatccaccaccgtccaggctttcaggtattctcctttctcatcatacactttcttctgtacagcgctcagtgacgaataattctgggtgaaacgtggtgttttcccgcgataacgggcacccagccatgatgccacctcttcggtgatctgccagttcagtttcgcattcaccatgtgttcaggggtataactcagcggcgcacctttgttatcaccatcacgttgttcacttcgggtccaggtgtaattcagtgacagcgtgacatcctctgaccacagcggcaatgtgccggcaaattccacaccgtgcaaccgggcctttccgctgtttacatagctattggtgttatcatttatggaataagagacaatcttgttggagaagtcagtcataaaacctgtgacattggcattcagaccggcggggttatcgtaatacaccccagcctcataactgacgctctcttccggcttcaggtcggggttaccaagtagatttgtttttccctgcccggacacaccactaatccctttatgtagctgccccattctgggtgccttatatcccgtggtcacaccgcctttcagcgtccaggcatctgccacatcccagaccagatatgcacgcggactgaagtgtcccccgaattgctcatgatgttcatagcggctgcccgcagtcagcgcaagtgcatccgtgagatgccactcatcctcagcaaataccgaccagcttttctgccggaaagtttcacctgtgctggcaaggacaactccgtctttcatggacgagctctgaaactcgccccccaccgtaaccagatgagattctcccagaggggtaagcagtaatgaattcaggataaggttcgattccttaagctcccgcggctgaccggcaagcccccatttgtcgcgcttcagtacactgcgtacgagctcacgacctttattttctgtctcgttccagttcagatacgatttccatgttccgaaggtgaaagtatgatcatagccagctgaaattttgttccgctcatagcgcagggtccggtcatatccccccgtcagactccccagttgcccatcccggttatcataacgctgccgggtggtatccatatcaaaccagagcacatcctgctccgacgccttccagtcaagacgtgcaccaagattataattctgtgactccgtgggataaggaatacgcgtggctgctgtatcgctcagtgatgtgaccgatgagccctgacgctgttgtgtgctaccgcgtacctgcaggctgacagaatcatccacaagggggccactgctccagaaattaaactggctgctgttaccccatttgttgctttcctgcagattcagccctgcattgacggaagagagccatttgtctgcattctttctggtaatgatattcaccacaccgcccatcgcatcagagccatacagtgtggacatcggccccctgataacctcaatacgctcaatggcggccagagggggcatgaacccggtattcatggcagaaaaaccgttgggagtcacgtcactgcttccgccctgacgaacaccatcaatcagtatcagcgtgtaactggctggcattcctcggatgctgatttccagcccaccggttttacccgtaccactttcaacatccacaccctctactgatctcagagcctccgccagatcgtggtactggctggactgcaattcctcctggctaatcacagaaacactggcggctgcgttagtcagctttttctcatagccggatgccgagacaatcatcacatcctctgcagcagctatgctgctggctgaaaatccgagacagggaatgactacggaagccagagtggttattcgcatattactaatctccgatcatgttaaccggcaagacaatacacaaacacaaacaataatgagaataatttatatttgccttttacaaaaaataaagattattgacaaaactaaatataaataacaactgcctcggcatgccagttaacagctatccgtatggcgtgttcggttttgcgaataaaaaatggttactgtagaagcggatttccaccacatgtcaaccatgaatggtcagtggtgcgagacgactgggatgatttggtcgatgacttcttccggtgaatactgatagaaacattgaaatattgtaagagaaagcgttcaaaaattctgtggcacgtgaaaaattctacagcgtcatcaccttattcagtcgaccttcaaaataaacgtttaatagagacaatcaccatttggattgtccgctgaggaggcgaacgttttcctagacagctttatcatgtcagcccacattgttggcgctgacaatactaaggacaaacgatggggaagtagctttttagcgttattttcgggagtaaaaaacatggtatctttccgtatgtcagttgtatcttgctggtattcgtagtcgtgataaggcatacaacgatatttatcttcacgttagtgaagaataagttgttttgtgatctatgttaatctgggattacaatccgggcttgatacatcgcatcacgacttttattctcttcagaatagaatatgttactccccgttttacaggctcaggatttgaattacaaattatacttttaagtgaacaataaccaggggtatttcttatttcctgaaaccaggcttggcccatttcgggatgagtttgaaaaaactcttgacgcatacgatagtgatgaaataaacgaaacaaattacgtcaacaaactcaggcgtcttgcctgacatgctcctgacatcattgatattcacgctcatctggcatatgcatttgcgctctttatgctgcaattctggcgaatgttcatttacagcgtcatcaggatgccgttatactcattgataaaatactaacatataaccctgagaataatcaggggacacgctggttactggggacggaattgttacgtgccggcaagcatgacagggctctgtacgtattgacaggacatgtcaatgaatttcccccctactggtacgagcttgctcttttacattttatgaatgaggcatatattaatgctgcaacggcatttcgatatggatttttaacaagcatatattgttgaaatgctttgttagaatctttatccattccctggggctgtatagtatgatttttcaagtatttctgaatacagcaaaatattattgcaaatattctctaaattattaattaaatatccataagcattattgcctgggaactggacatataattactcttctgtgctaaaggaacgttctgaaatgtttaagtatgcagagatgttgatggcggaagaagatgataaagtatgtgaacttatttttaaacaacaagataatttgattttaaaaataaatgatagatttcccagaataattataaagaaataccgaacattacaaggtaaagtcgtatggctatggatattgtcatttattattaaatggttaattttgcgtgctttaggtgtaaacagctggcgaggaaaaagtaaataccctgattattatttgttaagagatgagatacctgtgcgtctggtgtctattatattcccaacattattggcgctattcttgctggcgtaggcatcgccatactatgaatattgtgtttgtcgtgattcaatttttatttataacctctacccggagcaaattcaggtaggtcatgcataaaaatatctttctatactacgaaactacgaaactacgaaactacgaaactacgaaactacgaaactacgaaactacgaaactacgaaactacgaaactacgaaactacgaaactacgaaactacgaaaattatttttgtgaaagtattgacaacgctaactatttttaattatatattcatggtgctctaggcatcacattttctccatggggtattccctacgccggcactatgtgttgctggcgtttttttatcaattcttactttttaatcccactgtcctttccaccagaaacatacctcgtttctactgtattttgagaatatagttcccagaataccaattatatataatacgttgtaatatatgtattccaattaaagccgttattataataattatcatatatggttcttttcatgttgatttcgtcagaaacagaaaatgctgatgatgaattgtgaataatcaaactgacctctaattatcctgtatggagtagtgcttattttcgactcaatttctactgattagattatggttatcagtacagtgggttatgaaaaacggactggatctgccagcagtgcttctattattattcaaaaagaacttcagccggacaatgctataatccagggaaaggctataagctctgttggacggaatgtggaaatcagcactggtaaaaaggggaactgacattaacacaagaaggattcctgcaagcaactgcttatctgtccggaacgcagaattaaagcatgaccacacaggagccagaatactgtggtcgtacgcattcagtattgtgacaactaatagaaataaaaatctggccggtgcgaatattaaacgatgcgataccgtatagtgtaagtcaaaagtaacggggtatttaaaccatcttttcatatttatttaacataatgcagattctgatgtattagttcagttgttcgccagaatcagcgctcgaccacgatgcgattttgcagtgtgccgaagaagttctccatcactgcgttattcagaccgtttcctttgtgtggcatattttgtgctactccatggggctttaactttgcctatagcctgccattcgatattgccaaccctgatccgtatgtagttacggggcatcctccgggccgggcaccgacaatgtatcgtgcaccatcgtattaacaatctccattaccggactttatgacaggcgcaggagaaaatctcccggttaaactgaacggagaaccagcgacaggtacctctttttaccctgtagcaagtactctataacatactcccccatttttcgttggccttcattgcagcaaagttccggctcaggatattgggcgcagatcatcctctcaggaatttcaggatctgccagacggtgctgagacgacgcttacttgtaaggttagttttcagacggacaatgaaatgaggatatgcgataaatttcagtcaaagatccataaaacagaaataatgttattcagtggtgaacagtccattccggagacggaatatcttgttaaggctgtatattatactggctgtaaacaatactggctgtaaacaatactggctgtaaacaacatggccaccaaggaccatgttgtttacagcatacccttgttgcaaaagcatccccgtcagaacagcactgagtagttcagaccaaaggttcggccccggcctttgtagtcgtacagtgaagcagggccgtaacccgggctgtagtacagaggtgcacgctgtccccagacagtggtatagtcacggtcgaagaggttctcaacgctgaagctgagtgttcccaccggaagctgccaactactgataaaatcgacggtagtgtaaccattaatatcgttaccctctgcatcgcttacgtcgaaagaagtggtgctctgtacacgcagactccacggttccggcgcccagttaatgtaagctgtcgctttcgatggacttgattccttcacgtcatatttttgccattgaccgttcactttcgactcggttttcagcacattgaagttcacaccggtactccagtcagtatccgggatcaggtagtccaccgcaccttccacgccgtaaatacggcgcctgtcgtccttcacactgatggtcagatctttattcctttccacgctcttattggaaagcgagtaatatgccgcgatttgagtccgcaggttgtcaccggtaaagcgccagcccagttcataagaatcgactttcacgccttccagcttactgtcgctgacgttcacgctctttgtcagggaaagatggccgttcactgctgcaccatagatgccgcgaccataatatttccccggatccggcaatgccaccccctgggaaaaattgaaccatgcctgctgacgttcggtgatgtgcatcagcagaccagcattgaacagaaagttatcgtaatctaccgaaccaccaggaatggcgtcggcagatatcgccttcccggcagcaatcttctgttgctgcgtgtagtcgatgaaatcatctaccctgttctcagtatactgatagcgtacgccaccgctaacggtaaaaatatcattaatgtcatagctggattgcaggaaggccgccagattggtgatgtcatatgacggatagcgcccggtggtgtaaatcttatggttgttcagccctccggaagcacttgcctgagccagatcgaagaacatctggttggaggtaaagcgctcatgctcagcatccagcccccaggtgatttgccagccgtccatcagttggctgttcagagtcagtttcatgccgtactggtcggtatcctgctgtgacgaggagaaagccgtcgcctgtttattcgcatttaccgtcgggaacgggtagtaccgcaacgactcatcgcggtagtaaacctgaccgaccagttcctgtcccaggaaatcactgtcagagtactgcaggctgatcaaatgccgctcagtgccgggaatgcggtcagaattcagtcccttactgacgtatggtgtgctgctcccgctgatggcggaaaagcctttcccgagattaagcccgtaattgtcgtctccctgacttttatagtactgcgttatcagttgaagctgccgggattcatcgatgttcagcgtaccggttcccatgatgtccagccgattggagtgctgcaggccggtctgggtgttatcaagcagagtggcatcgccgttaccgtcaaaccagccgccaaatttctgatatgccacggaaagacgtccggagatatggtcatttccgccggagacagcaccggcaatgcgctcatcgtgatctttactgctgttaaagccactttttgtgccagcctcaaactccatcatggtttccggctgaccttttttggtcacgatgttgatcaaccctccggtactcccgccaccgtacagggccgtcgcgccggagatcacttcaatatggtcgatattaaaaggatcgacagagtccagttgtcggctgtcggaacgtgaagagttgaggcgcacaccgtcaatcaggacaaccagcgggcggccacgcatgttcataccgtagttggttcgactctggctgctgacatcaaggccggggattaactgagccagtgcgtctttcagctctttaccgccctgaatctgctgctccagttcggcattttcgataacccaggtggtttgcgccatctccgctacagttcgattgctgcggctggcagacactatgatctcattatcatcgttttgctgggcgacagctggtgacagcacgacaagaagcagcggaccaagagcccggggcatatactttttgcgcatcatcgttattcctgaatatttgctgtatagtgagttaaagaagcagcctccggctgcggttttttccggctgccgctgcgccactgaatcagtgcgggcggcatactgagatcgaataaatcacgccccagtacgcgattaagaatacgtgcagatcgccaggccatcaggctgagctggggttcggcgatgccatgagtttgcatgctggcgttgaccgcaaagatgttattttctttcgggccactccattccagagtgaagtcatcacgcactttaaaggtgttcttatcgtgcatggtgatcaagggcatcagtgagggaagtatttgtggcaatgcagaacggtaacctgtggcgaaaatcaccacatcactttccaggctctctctgccctgatccagatgatgttccatcaataacctccagcccggaccactactttccagagttgttaccgagcgactgggtagcagacggatatttcttggttttctcagaacttcaaaacggtggtacaactcacgataaatggtcagtaaagaatcggcagtgatgccatccgatgtcattttctgctcatccagtaactgatggcgaatatcttccttcagtccggagaagcctgaaatatattcaggtgtaaaatactcatcagcaaaagcagcctcatccagtgcgttaaaattattacgccgtgagacccagtttatttccgccgcttctccccattccccgcgtaatgcattaaggaacaggtctgcaccactctgtcctccaccaaccacggttatccgtttttcactcaggtccggccgacgaagattcatttcactggcatggaaacaggattgtgtcacatgcttcacacagggtggtaaataaggttgttttcctgtaccaaggcagatattgtgggcaaaatattctccccgactggtctgaaccagaaacaatcgactttttttgtcgaaatcaatattttcaacggtatgactgaaatacaggttattcatatcttcagcagcccagcggagatagtcagaaaactcttcacgggatactgtacgtagcctgcttgtaaggaagcgatagaactttttgtgcttcaccagatagttaacaaagctgtagggatttgtaggtgcaactgcactgaccagatctttcagaaagacggtctgcatatgacaatccggtaccagcatacccggatgccaggaaaaatgaggatgttcgtcaaagaagagacagttcagttcttcgatctgatgtgacaatgcagcaatgctgagattaaatggccctgtcccgacaccaataaaatcgacactttttttcatgattcatattcctgagttaccagccacagcggattttgcagattctcaaggtaattcggcagcatgcgactgccgccatccaggtccggccaggtcagttttaccgggttcagcaccacgcgaatgatttgtggcctgaagagtgagaaaagcgcaaaacgctctgccatttgtggatgtttgttcatgtaatcactcaacactgctgccagcagttgataaaatcgcctttcaggtacgccaagacgaaccatcagtggcgaaataaaacgcagtactgtcacgaagtggcccgtctgcaaatcatggattaagtagtccgcactcagacgggatgtgacatcacgcacctcctgaggcaaagagtccatttcgggaaacgcttctttcaccagccgcatatcgccctggaagtctttcagcagaacacgctgtggtaccccctctttcatggcgagcgttatattttgtccgtgtgcaataagcgcgacaccgtagcggcaaagcaggtgatacagcggaaccacaaccacccggaacaattgcgtaagccaggtttcagcgtccagtccggagcggtcgatatatgcgcctgccagcggctgattgttttcgtcgcactccatcagtgttgccatcagaacaggactttcatccggtttcagccagcggcacggattctcccgccagataacaccaagcatttcctggtagcgatagggagcccgggcaagcgcggcatagccttcatgggacacatagcctgcagccggttcaccaaggatcactgcgccgctttgcaccagggtggcgtcggtcgcaaaaacctgttgcagccagcgtgaagccagtggtccggcagcgatatatctgccagggatcccccggtagcatgaggtgttgtagatggtcagcggcagcttgatatccagccctccccggcggctggcgttggtcagggtacgcagcgactgctgggcgagccactggtcgccaaactcgccgagagacaccatcctgccttcggcaaaatcagcgatgaagtctgtggcgattttttgctgccactgccacggatgtaccggcagcggcagccagttgtgatccagcccgttttcctgccagacctgactgaagcgtgtaaactcctgcggatccattgcggcagtcaacaactgctgaatatccagatcgttatcgcagcgccagatcatatgttcacgttttaccgccagccagtgcagtctgaaggtgttggtatactctggcgcatatcgttccagcgcctctttgccccagccacggcgacctttattaaaaacgaatttaggatgaccgctcagcaggcattgcagacgatcggcatcaagattaatcaggtcactggcactcagtccgcgacgggccttcagcagttgcaggtcgcccagtagcgtggcatacaaatcctgcatatgctctgcaacagtggcatcactcattgacagcaccggctttagctgcatcagcagcgtctgcgccagtactggttcgtccgtgcagcgcaacgtttgggcatcaatccacagccagccccagataccacgttcagcgatgaagcgccattgtgctcccggcaggttaatgcagtagtggtcatcgccctgagattccgcgtggaaaacctgctcatactccatctcagacaacatttttgccaccagccgacggttaacaaaatcccagtccttgtgattcattacagaccgacctccgtgaagaagtgatgacgatccgccatcaccatgcgcgagcgcttatgtgggaagtcgaactctttaattgtccggtatcccgcaggctcaagatggcggaacaggcgctggttatcggtgcgtggctccagtactgtgcgctgcgtacggggctcatccagcagcaggtaatgtgtcagcccgcgcagccagctttgcacatagtgggccccgcgccattgctgttcaccaaccagcagatgcaggccacggtcaaagggctgccacgaatagtgacgaccaatgcggtcttccgccgcccagtagatttcgaaatagctgaatggccgatcgtcgaagcacccaatcagcgggaatgcatgtttaccggtgagctggcgctccagataggcggtctgtacctccagtgagccactttgctcccagaaatactcaacgcgcggatcattcatccagcgggtgaaacgttctgcatcagaaacgggatcggcaatgcggaaactcagcatcctgcgaatacgtggatcgtaacggcggtaaacctcaccctgtggacggggtgggcgctgcgggaaataaatctcacgctctgcatcaaaaaccatttcaccggaggcccggtttgccggtgaactcaaccataacggtaactgccagaaggcagtacgatggataatgtcgctttttacctgcccaaaaagcgtcagcgcctgtggctcctcacgccattcggcccaggggagagccactgctgacagttgtggtgcggcgataaatatctgatccagcgcatcgcacagccaccctgtcggcagctccccggaacagtgcaacaccgcgctattgtccagtccccagccaagattcaggggcttgtcgagtttttcacagcgcagtccatatctgctgtgaataatgtttgcctcagacattcagacctcctgagcctgcagcgggttagcgaaatcgaaatagatcaccgaagggtcaacaatggtgttctcgttatgatcgttcagataacagaaaaagttaccttttacgttccagtacggactttccagcacgtagttgagacaggttttatgagtcacctgatcacgcacttcagccagcgatgctcgtacacgagccatcagattcgattcgctgtccagcccggcagcccccagcgcagcggtcacagcaaaagtggagttaaccagcaggtaataagggaaatagcgcagcaactgctcatgggtgaaaatattttccgcctgcgcctcgccaatagaatcgagccagtctgtcgcgtgaggcataaaagcgctgccctgacagtcacggtaaataaatccgaccggcagatccccaagcatctggacaagaatattttgctgatgcgccagcagcaccaggccgtaatccgcttcagccgtaaacagcggctttagcacttgctgacagtatgcatcgacccatgcatgggcggcctgttgcacagtgataccgaggcgatcgctcaggcgttttaccgccgaaaccagcagcgaatcaccgccatcaggtgcggcctgagtcagggagaccagtacgttagtctggcttttcggctgatccaccagcagattttcacgcagggcaaacagactttcctgcatgatgttgccgttaagatcgagcagcccggcccagccatcctcctgcattacccggaaagtcgggaagcggacctgtagcatctgccagccgtcggtttgagccaggcgtgccaggcgcatcccacgcttcacttctttcacggacagagtacggatggagttggtcagccgtacgctcagggagaacttgatcatatcgcggctggtggcacagtagagggaacgggaagaggtggtcggcagccacgacgtgccggcctcacctaagtctttaatcagccctttagcaacaagtgcctggcaccacccctgctgcaaaagatattccccctgccacgggtgcaacgggaacagccattggttgtcacttaattcgttgagtaactgaggcgcattctctgcggcaaatcgcgtcagccgctgttgaaggttgagatgcaaactttcaccggcgatttgcgttttatccaccgaaaaccaccgcagtgggaagtggggtgccatatcaggcaggtagcgttcagcctcccgccggttaaacggttcatgagacttaggcgcagggtggaaagcgtgtcctgtcagcagcgcctgctcagcctcgccaaaattcaacgctttttcacgcagagcggcccagtcatgacgggcatcaattgcctgttgcgtatggacatggctttccagcacgcgctggtggaaagtttcgcagaggggaacgggcagaaacagttgatggcgtagcttatcaataataagccgggagagagtggtaaagtcgacaggataactgcctgatgccgtgaccagacgtgcaggaaatgcaaagcggtgatgctgggttggggagaaataagccactctgaaatggagcgatttctgctcatccagcgggatgagcaattcgtctggcgggtattctgtcagtttccagtctgtggtttcacgaatcagtgcattcaggaagcactgctcagccacatctgtggctggtttttcagagggcagggtcatagtcaaacagctcccacacagtaaaataataacaattatgtcaataatgattctcattatcaacaataaatgttattgtcagataaattaattttacaaataaacacaattaatacatggagttgaaacattataatgtcaccagggatcgaagatacgccccaaaaaccactgtcctgctggccacttgcgttcagtgctgggcttctcggtatcggacagaacggtctgctggttgtgctccctgttctggtcatacagacaaatctgagtctgtctgtatgggctgccctgctgatgcttggctcaatgctgtttctgccatcgtccccgtggtggggaaagcaaatttcccgtactggcagtaaacctgtggtgttgtgggctctgggaggatatggcataagctttaccctgctagggctgggaagcgtgctgatggctaccagcgccataacaacagcggtgggactgggaatattaatcatcgcccggatcgcctacgggctgaccgtgtcggcaatggtgccagcctgtcaggtctgggcattgcagagagctggagaagggaatcgcatggccgctctggcaaccatcagctccggcctgagttgcggcaggctattcgggccgctgtgcgcggcagcaatgctggccattcatcctctggcgccactggggctgctgatggcagccccagtgctggcgctgctgatgctgctgcggttgcccggcacaccaccacagcccacaccggagtgcaagagcgtcagtctgaagcgggattgtctgccttatctgctttgcgcagttgcagatctctctgacggagggcttcagcctgctcagagagcagcctttccagctcagtgatacgaatgaggtatttccgactcatgaccgtttttataatccggccatgacatttttacaacattgtcagtgcgttaagacgggatgtttttggctgacgccagtccagcttatcgaggagcattgccagctgcgagcgggtaatggataccttaccgtcacgcaccgcaggccagataaactggccttcctccaggcgtttggtgaacaggcacagaccatcagcatcagcccagaggattttaatcatgtcactccgtcggccacggaagatgaacaggtgaccggagaagggggtctcatccagcacatgttgtacctgttcacccagaccgttgaaggatttacgcatatcagtaacgccggcaaccagccagattcgagtgtctgatgggagcgagatcatcgccccctcccggtcagttcacggatcaacaccgtgagcagctctggtgaaggattttccagcgtcatgttaccgtggcggaactcaactttacaggaactggcactgactgtgctttgtgaaggagtggataaaagcggagtaagagccgccataggctctttctgctcatcaggcgttatctcaacaggtaataattcaacgccagcgccagaagaggttgttaccggaagacgccgcgatatacgcccttcgttctgccagagcctgagccatttgaacaggaggttatcattgatatcgtgttccctggcaatacgggcaacagaggctcctagttgtgaagccagtttaaccatttgaagtttaaactcatttgaaaatgttctgcggggttctgcggataatattttctgttccataacaggtgtccactagttgatgaaaaggtgggcacctacgttaccaatactggcttaatggctacatacggcggtcagtttacgcttaccatgtatctggcgagtgaagctttatgtcgtgttctggcgtgtcctgtgttagttagaacacgccatcgatggtcagcaggttcatattgcaccagagcggatacagcgtggtgttatgtcagggctgcgctgtttacgtgaacacgtggcgtacggccccgcttcctggccgctgctgggcatggatcacggcgcgacaaaggggcgactacctggcagcatgtgtccagccggttcacaatctggtgaaggttccttacgctcatgggccatactgataattcaccaggccatcatttccagaggaagacgccgtttgcgtagcgtgacagtgtcggactcttcagggctgtgggtaatcagttccggggcaagatagtcgcagagggttacgcagagaatggtaactggacactggatcgatcaaccgatccttaactgagcggcatgacagctttctgatggtttttttttgataatcttcacattgtgcttcttttctgttggataatctttgtacttggtggtgtactaggtatcccattatgcagttaagtgaaggtgattaaaaatgcaatgtgaatttaaaggggtcatatcagcattacccactccttatgaccaatcccagcaaatcgatatggagagtcttcgaaaactgatccgttttaatatcgaacaaaatattaagggattgtatgttggaggctctactggagaagcatttcttcagaatgttgcagagcgagaaaaaattcttgaaacagtagccgatgaatcagatggaagactgacacttatagcgcatgtgggcggaatcagtacggcagaaagcgaggtacttgcaaaagctgcaaaaaaatacggatatcatgctatatctgctgttactccattttattatcctttttcatttgaagagcattgtatccattacaggaagattattgattctgcagatggacttccgatggtagtttataatataccggctcttagcggagtgcgtttttctttagatcagataaatgagcttgtcacaatacccagggtttgtgcattaaaacagacatccggtgatttattccagatggaacaaatcaaaaggaatcatccagagcttgtgttatataatggttacgatgaaatatttgcatcagggttaattgcaggtgcagatgggggaatcggtagtacatataatataatggggtggcgttatcttgaaatatttgaagcagtcaaaaacaatgatgtgattaaggcgaaggaaatacaggtagcctgtaaccaggttattgacactcttattcagagtggtgtcctggcaggtataaaaactcttctttactatatggggattataaatactcctgtatgcagaagtcctttttctccggtaaaggaaaagaatctggatgtattatcaaaacttgcagagcgactgctcgaagaacatgacagaaacaaaaaaatgaaaataatctgaataattgcaagattgttatataggtgaaaatgaatgataacactggctgttgatataggaggaacgaaaatttcagcggcgttgatatctgatgacggtttatttttgctgaaaaaacagatatcaacacctcatgaaagatgtcctgacgaaatgacaggggctttacgtctactggtttctgaaatgaagggaacagcggagcgatttgcagtagcatcaacagggattattaataatggagtattgacagctctgaatccagacaatcttggagggctgaaagagtatcctctgaaaaatataatggaagatataactggtttaaatggaagtgtgataaatgatgcccaggcagccgcatgggcagaatatacagttttgccaaaagaaatttgtgatatggtttttataaccgtttctacgggggttggagggggaattgtagttaacagaaaattattaacaggtgtttctggattagccggacatgttgggcatatattgtccggagtaacggatacagaatgtggatgtggtcgtcggggatgcgttgaagcggtttcatctggtcgggccatcatgggggcagcaaaaaataaacttgcaggatatagcaccaaatatatttttgaattagcgagacagggatataaggaagcagaatttttgacagagcgttctgccagtactattgctgaattaatagtaagtttaaaattactgcttgattgtcaggttgttgttgtcggaggaagtgttggacttgctgatgggtatgttcagaaagtgtcgaaacatctttccatatattctgaaatttgtaatgtaatgctgtttccggcatatttcagaagtgactctggtcttattggtgcaactctttgggaccgggattgtattacttaaagtaatactccagtgtattataaatccgctattattgtgaggtttaatatggactcctgtattcagaaaaagcaggtttggtataagcatctttcacccagacagtggaagatattcggtgcggcatggacaggttatttacttgatggttttgatttcgttctgatatctctggttcttacagaggttcagcatgaattcggcttgacgacaatagaagcggcaagccttatttccgctgcttttatttcccgatggtttggggggcttgctattggcgctttatcggacaagatggggcgcaggatggcaatggttttaagtatagtgctattctctctcggaacccttgcctgtggtctggctcctggatatgcagtgatgtttattgctcgcattgttattgggcttggtatggcaggtgaatatggctcaagtgtaacatatgttatcgaaagctggcctgttcatctcagaaacaaggcaagtggttttttaatttctggattttctattgggggaggtttagctgcacaggtttatagcattgtagtaccactatggggctggcgttctcttttctttgtcggcatgcttccaatattatttgctttttatcttcgcaagaatcttccggagtctgatgactggcaaaaaaggcaacaagagaataaacccgtcagaacaatggtggatattctgtacagagaaaagaataaatacataaatattcttctgtcttgtattgcatttgcatgtctatatgtttgtttttcaggcgtcactgcaaacgctgctttaatcacagttatggcattgtgctgtgcggctgtttttatcagttttatatatcagggtatggggaaaagatggccaacaggcattatgttgatgcttgtggttatgttctgtttcctctacggatggccactgcaggcttttcttcctacatggcttaaggttgatatgcagtattcaccagaaactgttgctctcatatttatgctggcaggttttggctctgcagctggaagttgtataggtggttttatgggggactggcttggaacccgaaaagcatatgttatatcacttcttatcggtcagcttgttattatccccgtttttcttgtggaccgggactatgtatggttacttggccttctaatctttactcagcaggtttttggtcaggggattggtgctctggtgccgaaaataatcagtggttattttaatgtggagcagcgtgcggcaggactggggtttatttataatgtaggttcacttggtggagcatgtgcgcctattcttggtgcagttgttgcgtctcatacaagtcttggtacagcaatgtgttctcttgcttttatcttaacatttgttgttcttgtccttattggttttgatatgccatcacgtgtacagagatggatccatccagaagctgcgcttgaatatgatactgtcgatggaaaacctttttatggagcaagaaaaaagaatgttgcagaagaataacggatgctatcagggaataaaaaaatgattcattacagggagaatatatattctcttgataattatgagcgttacataactgacagttcgctatttgagaatactggcgatggcataatatatacaggtattgtgccccttattacagttgttgagcctgttgtatctaatcaacatagtgtgctgattatacctggaggtggatacaggaggattgtttatgaaagagagggacttgatgttggcagatggatagcaggtcagggatatacggcatttattctttcttacagaatgccctccgttaatggttattattcctttgcagatgcgaagaatgccctgaactttatttcttactgggccggaatgtcggagagaacatttaagagtgttgggtgtatggggttttcggcaggtggtcatcttgctggatatattactcatctccattatgaggaagagacttctgtgcgtcctgactggatggctctgatatatccagttatatctcttgacaggagtattgctcatcagggatgccggaaacgtcttctggatgcaggtgaaagtgaatattcagccagtcttgaaaatagtgttacagagtatatgccaccagtctttattgtgcatgcaacagatgataaggatgttccagttattcattctctgagatattttaactctattcgggataagggacatcatgcagaagctcatttttttgataaggggggtcatggatttggtgtatccggaaaaaatggatatccgatagaaaaatggcaaagcctgcttctggaatggcttgcggaacataagtttcattgagaaatcaaattacaagtgataaatatatttaatgatgaggcatttatgaaaaaatattatccactattaactgtaattcttcttggtttacctttgtgctctcaggcattaactcttaatctacgtgggggatacagaagcgccagtcacgcttatgaaacgttgattcaggttagtcaggggtggaataatggttggtgggcaagttttgagtcaaacacctggaatacaattcacaacaatgaaaatgaattgtttgcactcaattataataaaatagatataaataaaacatataaaatagatgacaaatgggctctaatcccagggattcagacacaatggatgtcagcaggaagtcagtataacccttatctgaaaatttcgtatcaggcaacgccagatcttaatctggccttacgctatcgctatgactggaaagctttccgacagacggatttagatggcaacagggcgcgtaatgatcagcatcagtttgatggttatgtgacatacaaaattaatgattcatggttgtttgcatggcagaccacggtatatacgaaggttaataatttcaaatatgggaatcataaaaaaacagcaactgaaaatgcatttgttctgcaatataaaatgtcaccggtgttcaccccatatatagaatatgattacctggataaacaaggggtgtataaggggaaagataataaacatgaaaatagttaccgtgtcggtgttctgattaatttttaaaaggtgattacaatgaaagtgaaaaactttatatatcttcccttctgcttgtttattggaacgtcggtagccggagctttaccggaaattcctgaaccatttaaatatggtgtaggagggatcgagaatggtaaaatatatataggactgggaagtctgggaaataactggtatatgatagatacaaaccagagtgaaaaaaaatggactaagatagcacaatggccgacagttcccagagagcaggcaacagctactattattgatggtaagatctatgtatttggaggaattggaaaagataaaagtggagtcataaccttacaaaaagatgtctattcctatgatattgctaaagataaatgggaaaaattgatgacccgtccccctgtatctcttgccggtcatgtttcttttatccataatggtcatgcggtatctactggtggtgtaaatgagaatatttttaatggatacttttcagatgtcgagttatcaaaagggaattccgcgctgacagagaaagtcaacagggattattttagtaaacctgctgatgattattttttaaataatcatataatttcttatgacccgtcaaaaaaccagtggaagaacctgggaacgactccatttccgggaactgctggttcatcggtgatttttgcagaacagcaaatttatatactgggaggggagagaaaaccggggcttcgttctgttagatcctggacgggggagctttcgcatgatcgaattaaatggtctgaacttccaccagtagcttcacccgagggggtgtcaggagcatatgcctctgttattgatggaaatatctttctggccggtggtgcatatttcccgggggcggcagaaaagtatagcaatggtgaatactggtctcataaaggactggataaagcctattcaaaagagatatatcagctaataaaaaatgactggaaaaaagttggttctttgccggaaggacttgcttatggtgtaagcctgccctggcagggggggatgctcattctgggtggggagaaaaaagatggtaaagctgtttcagatgttatttatctgaaaaaaaatgacaaacaaataaagattgttaaataactgtaatgcaggtgactgtattagttgttcagtcacctgagttattttaatggggtttataatgaataaagataaatctttaaatgaaatgatgttaagcttgtttaataaatcaactattgttgacttgtcaagtgagacaatatctgagagtaaatctctttcaggccgtatttatcaggatcctgaacataacggggaatttgaacttgatcgtgtattgacagatatttatgctcctcagttaattatttttttaccagataaaccaaatggaacaggaatattgattattcccggggggggctaccaggctgttatgttagataaggaaggtacagctcttgctccagagtttttatctcagggctatacattatttgttcttagttacagattaccatcgccagctgaggaagaaaatataaacaaaacttttattgatgcaatatctgcaatgctttatattcgtaagaatgctgataaatggcatctacagcgtcatcgtattggtgtattaggattttctgctggggggcatatcgcctcaacgtttgtgaatcagatttgtgatttcaaacgttcttctgacagtaaagaacaagagattttcgctattcccgattttgtcgggttaatttatcctgtaatatcaatgaaagatgatgtgacacatccaggctccaggaagcaattactgggggataatagtacctcagaaaatataatacaatatagtgcggatcttaatgtcacatcatgttttcctcctgtgtttttactccattgttgtgatgatgatcttgtgtcaattgaaaacagtctgctcatgtaccgtggcctaatagagaaaggcgtttctgctgaaatgcatctctatgagaaaggagggcatggttttagtattcagtgggccacagatcttcctgttggaggatggataaaactgtttatggactggatgtattctcatggatttaaataatatttatggtgactacctggtgaagcgtcgagtaactatgatgcttcaattcgtttataaaggtgattatacattagctgttcagctttatcacaatcatgctcttttatggccgtaagtatttcaatatgctgctgatgggtttttttgttattttcatatgtcattttattcttttccagaggtttggccattatcagccattcagaaaatgctgagtgtattgtttttaatactttattgtcaggtatatcagcaagtatactatgaaattcaatatcatattgagcatacacttcgggggttctcagtgagttatgatggatactgagcaccttctcaagcctgtgaatatcctcaggcgttgcattttttgctgcatatcttacaaggttggtttcaaaaaagatgcgtagtctttcaaaatccttgatgccatcagctgtagataaaaaatctttaacaatgcctgataacccattaatgatggtttctggtgatggacggcagacactggctttttctcccttgttataccggattagccctttatgtctgagagatgataaagcctctctgacagatggtcttccaacgccaaagaatgccataagttcacgttcagaaggcaggtattcaccttcccttatctcctcctggcggatcattctttcaagctcttcggcaacgatttctgaaagtttttttgtaacaatgggctttctggtcgttgttagcccgggtaacacggtttttttgttgtcggacatatattgatttatatggattagagcaaatgagtttttaatttaacactttcttttaataatgaaaatatttaattaaatctattatgtaaaggggggatgatgtatcatcatgattttaatgaaaaaataggtttctggtatgtgatagccctcgcaggacagtctaatggtatggcctacggtgaaggtattcccctgccagatacactcgacaaacccgagtcccgtgtaaaacaactggctcgtcgaaaaacaatcacaccaggaggaaaagagtgtaaattcaatgagattattccggcagatcactgcctgcatgatgttcaggatatgagtggatatcaccatccggctgctgatttgcataaaggggaatatggttgtgtcggacagggattgcatatagctaaaaagttactgccatacatacctgagcaagcagggatattactggttccttgttgcagaggaggtgccgcctttactgttggagctgaaggtatgtatgtacctgatacaggggcaacagctgatgcaatgcggtggggcaccggaacagcactctatgaggacttagtagcccgggttaaggtagctctggaatataacagaaagaataaactgctatctgtctgctggatgcagggggagtttgatcttatgtcaccagattatgaaaagcatcctgacttgttttatcagatggtaacttctttcaggtctgagttatctgaatactcatctcagtgtgttggtaattcgtcagaaagagttccatggttgtgtggtgatacaacctggtactggaaggaatcttatcaaaaagaatatgattttatatatggacattacagacaacggactgatgatgaaatacattttctcagctttcaggatagtaaccgacatgaattaactaatgagccagaagaagatgccgatgatttatctgtcgggtatctggggtcatcatggaggacagaattaagctggacaacgtcacagagaagtacacattttaattcaatggccagaaggggagttattgctgaatgttatgcgcaaaaaataagaaattatttgtagacaagttcaggatatatctacagctctgacatgattctctgagagacatgacggagtggcggggcagcaagccagaacactgcctgacatgctttcatcagacgcaggtcctctctcatatcctctgatttactccagtaaggtgatgatcatatctttatttgatagtacggtaatgccagataaatacagacacaatggtaaataatatagttgcaaataatgctgccataatcagcgcgattgcgacacctgttttcgataccagcggcaccagcaaagcgcacagtccatagccaagtgtgtgactggtagcgagccagcccgcgcctgcgccatcagccagcttatcattcagtagaagttgataagcgggtgttgccagagctgctccaaatgacagcactgcacagcccgggtaaaacaaccatagctgttcggagagcatgatagccagaccaccactcatcaacactccggcactcaggagcagggccaccggagtcaggcgctgcggacggagtaccccgaactgcgcgataagcgcagctactgcggacagacccaacagccaggccacctgttggctaatggcggtggtatccgtggcgaactggcgagtaagggcaggcgaaagtccaagctgcatcatgctcaccgccgcagccagtaaaagcgattgaagagcggcacatccttattgcaaacaagcaggtgatcataaagagaaaggatatgggaactggcaccgccagattgagccgttttaacaatataaccgtgctcagcgagttcatattgctcaggtttttcaatccagtcgccggcaacgctcttcagtagcctctctgagtcatacagatattgacgccactcctgctgcaaggcggcatatcgtgcttcccgttcttcatccgtttcggcagtcttatcaacgctgtcatcaaagttgatagagaacgtggtatgggtcgtcttgtatttgtcatactgcccaatctcaccaatcgaaaatgctccttttggcaaaggttcaagcaggtctctgggaatggaggtcgctggcgtcggatataaaaaaccctcacggcttagcaaggctggcgtcactatcggggtaacaatatcaggcgcacctgcagaacggtccttaccatgctgcagtaaccggaaataaacttttgggcgcaagatgacatcgaccgtttcgacatcgtctttttctcccttaaaaaatttactgacaatcgcttcgtcaagacgtcccgccgctatcccatgccagtgagtgaaatttttggcgtctttccgttcaaaactgccctttcctgactcagcatccgcaagcgagttgcgccagtatgaggtaaaccctaaagcattttcatccattaccagtcctgtgactcaatgaaatccattgatttatcgaatataaaaccaccatatggacagctattgtccatattgaaaaagttggatgcaatgttttgtttataattcggtatcaaatgtactggttgtacaaggttcagaacacaagcacattcaacagtacgtcaggactattgatttcataacagtgaatacattttttaccgtttataatgactgcctgtgttggacaaggataccagaacagccgaaaacaccgggggttattacctgctctcatggaaaccagatattcctggtgctaatcacagtcataaatagcctgaagaacatgacgaagggactttaatggaagccggagtaacttgccagaacatcaatcttcgtcatcatttacaaagaaaaataatcagttaaagcagtccgggcaatcagcccggactgcttactattttaatggattgttaatctttgcatattcaaacgggctgatacccttatctctgttcgcatccagaaaatctgcccaccactgtagcatcagtcgacgttcttccagatgttctgctttatggatatacgcagcacgtacaccattacgctcctgatggctcatctgacgttccacagcatcgcgggaccacaaacctgattcaatcaatgcactgcacgccatcgcccggaatccatggccacagacatcctgggttgtgtcataccccatcaccctcagggctttatttacagtattttcactgattggtttacgcgggtcatgtgctcccgtaaagatcagaccattttcaccagcccatgtctgtagttctgtcagtatggctacagcctgtttgctgagtggcacaagatgtggtgttcgcatcttggagccccggtgtgagaattttacgcctggcaggggttcgcgttcggctggaatagtccacatggcattgtcaatatcaatttcagaccagcgggcgtatctgagttcattggaacgaataaaaaccagtaaattcagcataacggcaagctgggtgacaggttgccctttgtaactgccaatacgcgacaaaagttcaggcaggcgagaaagatcaagagcggggcgatgctggcgttttaccgtagtcaatgcgccagccatatccagagcaggattatatctgatgatgccagactgtacggcataacgcattacggcagatattctttgctgcagacgactggcgatttcataaatttgtttagcttctgcagcacgaacagggataagcagatccggggtattgagtgttgtgatatcccggttgccgataaaggggaaaacgtgagtctcgaggcttttgagtactttatcgctgtgtgattgtgcccattgtttattactggcatgccagcgtcgcgcaatatgttcaaaagagagctgtaaatcagggactacttttttagctcttttctgttcgcaagggtcaaccccctccgaaatcagttttcgggcctcatcccgttttgtacgagcttcggagagagaaacttctggatacacaccaagtgccagagtcttctccttacccagaatacgataacggagacgccagtaacgggagccattaggatgtaccagcaggaacatgccagccccgtcagtgagtttataagccttgtcagtgggctttgcagcccggatttttgcgtcagtcagtgccatagttcagccttctgaatgcgttaaagagggtacaaattctgtcgaactggggtatgcccgcaattatacccacacaatggggttgatgtggggggaatctggttgagttcggtagaattgatttgtaggcagaacgcttaaatcgtggcgttctgaaacgaaaaacggacctccgtggaggtccgttgatatgaatttggtgcccggactcggaatcgaaccaaggacacggggattttcaatcccctgctctaccgactgagctatccgggcaacggggcgcattaaaccgtaatctgcacatctcgtcaacctaatttcagtaaaagcgattcaactgcttaagattgcggcaaatcgcttcttttctgtgtttctgtcaggtcagtgcaccaccctgacggcagcgggcgaagcgcaggatatcttccgccagccgatgtgcggtgtcgacatccgcctggctacgattcaccagcattcggcttaaacagccttccagcaccagttccatctgctttgctaccatcgccggatcgtcaacttccagcgtggttaacagttcgtgggtgaaatcgtaggccgcgcttttttgctgatcggccagttgatgaatagggtggccaggatcggggtaaaacgtacaggcagcgataaacagacagcccggatagcggttgtttttaacgcactccgataacgcctgataacgtgccagcaacttttgttcggcggtttgcgtttcgtccagcatcagctgacgacgccagacatctatctgttggctaagataacgcagcgcatcgtagaggattgcctctttgtcaggccagaagcggcgtagctcgtccagtggataatccacacgttcagcaaccatctccagcgtggtgttggcaatcccttgtaattctaataatttcagggcttctcccagtacatcttcacgttgcacgctattttcctccgtctttcccactgcaagtgtcgttcacggttggcgatcgcgcaaatgtgcgctgaaggtttcagcatccataaagcccgtgacgcgtgcttgtggatgctcctggccttgtccgtcaaaaaagagaattgtcggtaggccaaggacattaagatgctttaacagcgccacatcttgtgcgtcgttggcagtgacgttggcctgaagtaagaccgtatctgctaacgctttttgcacctgcgggtcgctgaaggtgtatttctcaaactctttacaggcgacgcaccagtcggcatagagatctaacatcactggtttgcctttggcttcaacgagcgcctgatttaactcatctactgttttgatttgtgtaaagttgagatgcgtctgagtttgcgcggtatgtgtttcaccaaatgcccaatcctgaagtgggcgcacgctaaccaatgccgctgccagcaggattatttgcaccacgcgcatccagccgcgtttggcctgtaggctggtgataaaggcccagccaaagaatgcgacaccaagcgccgaccacaagcgtaatccccatatatcaccaatcactcgctccagcaggaagaccggcagtgcgaggatcacaaaaccaaacgcggttttgacttgttccatccacgggccgcttttcggcagcaagcggttaccaaagacggtaattagcatcagcggcaggcccatgcccagcgcataaagataaagcgtgccgccgcccagccacatgttcccgctttgggcgatatacagcagaatcgcgctaagcggtgcagtggtgcatggtgaacagatcagtccggcaatcgcccccataataaacacaccgccaggtgagccgccctgttggcgattgctcatcagcgtgagacgtgtttgcagcgaagaggggagttgcagagtaaacaagccaaacattgacatcgccagcaaggtaaagacgatggcgaggccaatgagcacgtatgggtgctgtagcgccgcctggaactgtaaccctgcggcggcaaccaccagacccagcgccgtgtaagtcagcgccatcccctgcacataaataaaggtcagcaacaatgctctggcagtggaaagccgctgtttaccgcccagcacgatgccagaaatcagtgggtacattggcagcacgcatggcgtaaaggcgataccaataccgatcaacaacgcccagagcgcggaaaagggcaattgcgcggtgggctgctcttgctgcggaacagacacaggctgtgacgcttcgttgttagcgaccacttcgcttaacggaacggttttggtttctggcggataacagaaaccggcatcagcacagccctggtaggtgacagttaacgttgctcccgcactcgcctggttgatggttacgggaagcgtcagccgatcgcggtaaatctcgcttttgccgtaaaactcatcttcatgccagacgccttgcggcagctgcacgtcagcaattttcgcgtgttccggcgtaatgcggatctgtttacggtagaggtagtaaccgtctttgatctgccaggtcagattcagatcatgttgattttgctgaaaatcaaaagcaaaggcttgatccgcggggacaaattgtgaacgtcccggcgcgtcgaataatccggcaaaaacggaagtgctgcaaagtagcaggatcagcgtaaagatgcgttgagccatgagaggtaatctgtgtctccgtgtgtaacaggtaaaaccagaagttccggggtttgatatggatgatgagacttcaggcattccagcattgcctgctggtgagatacggtagtttttaaaatcatctgcacttcgtattcttgctccagcttaccttcccagtaatagagagaggtagcgccggggatcaaggtcgcgcaggccgccagtttttccgccagcactttggcggctaaatcctgggctgtcgcttcatccggtgccgtacatagcaccacgacagacgtggtattcgaacttttttcatcaagcataaacacctcgcaagaacagatggaaccgcaagagagaggtcactatacaacggacggggaaaggatgttagtcggcgggaaagaaagcggggcgtgaacgccccgcgatgggtcattacagcatgaagctacccagcacgaagccgaagcaaacggccagggcaacacccagagtacccgggatgaagaacggatggttgaagacgaatttaccgatacgggtagtacccgtgtcatccatctgtaccgcagcaaccagtgtcgggtaggtcggcagaatgaacagaccagacaccgcagcaaaagaagcaacagcggtcagcggagaaacgttcagtgccagagccatcggcatcagtgcttttgcggttgcagcctgagagtacagcagagcagaagcaaagaagaagatgacggccagcagccacggatgaccctgaatcacttcaccagcggtatctttgatccagtcgatgttgttggaaacgaaagtatcgcccagccacgcaacacccaggatacaaatacaggcgctcatacctgctttgaaggtgctggagttgagaatgttgtcggtatcgactttacagataacggtggtcagagttgcaacgctgagcatgatgatcaggattgcgttggtggtgttcatcagtggtttttcaaccagacccatgcttgggctgttgatgattgcatagataaccacgccaactacgcccagcaggaacagccagacggacgtttttgcaccggatttgatttcaatctgcttttcaccgcgcagttcaaccaggccctcttccagacgcttgcgataaatcggatcgtcagagagtttggagttgaacagcatagtgaccaggaaggacatcaccagaaccgccagcagggtggacgggatgaccacggagagcagatggaggtagctgatgccatgaccttccatcacggaagacatgtaaaccactgccgctgagattggcgatgcggtgatcgcaatctgcgcggataccactgcagtagacagcggacggcaaggtttaacgccttgttccttcgcaacttcagcgataactggcagtgtcgccagagagatgttgccagtaccagcaaagatagtcaggaaataggtcacgatcggtgcgaggatcgtgatgtatttcgggttacggcgcagcagcttttctgtctgatgaaccagatagtccagaccgccagcaacctgcatggcagaaatagcggcgataaccgccatgataatggaaatgacatcgaacgggatgttaccgggtttaacgccaatagcggcaagaaccagcacccccaatccgcctgcaaaaccaatacctattccccccaatctggcgcccaagaagatcgccagcaaaactatgatgagttctacaactagcatattagccttccttgttttttaacaagttgatattaaattgttatttttaagttactgctcacaagaaaaaaggcacgccatctgacgtgccttctttatttgtactaccctgtacgattactgttcgctttcatcagtatagcgttttgctttgtaagccgggtgcatcagattctgtacggagaaaatatcgtcaagttccgcttcagtcaacagaccgcgttccagaacgacttcacgtacactcttaccggtttcggcacagattttacccacgatgtcaccgttgtggtgaccgatgaacgggttcaggtaagtaacgataccgatagagttgtaaacgtaaccttcgcacacttctttgttagcagtgatgccgttaatgcatttttccagcaggttgtagcaagcgttggtcagaatgtgaacggattcgaacatggcctggccaatgactggctccataacgttcaactgcagctgacctgcttctgctgccatggtaacagtggtgtcgttaccgatgactttgaagcatacctggttaaccacttccggaacaaccgggtttactttagctggcatgatggaagagcctgcctgcagttccggcaggttgatctcgttcaggccggcacgtggaccagaagagagcaagcgcaggtcgttacagattttggacatcttcacagccaggcgtttcagcgcgccgtgaaccataacataagcgccgcagtcggaggtcgcttcgatcaggtcttcagccggtacgcatgggaagccagtgacttcagccagttttttcactgccagcggagagtactctttcggcgtgttcagaccagtaccgattgctgttgcgccaaggttaacttccagcagcagttcagcggtacgttggatatttttcacttcttctttcagcaagatgctgaaggcgcggaattcctgaccgagggtcatcggtactgcgtcctgcagctgggtacgacccattttcaggatgtcctggaattcgacagctttacgttcaaagccttcacgcagttggttaatcgcatctaccagtttaatcagggaagagtaaactgcgatacggaaaccggtcgggtaggcgtcgttagtggactgacatttgttaacatggtcgttcgggttcaggtactgatattcacctttctggtgacccatcagttccagaccgatattggccagcacttcgttggtgttcatgtttacggaagtacctgcgccgccctggtagacgtctaccgggaactgatccatgcattttccgttgttcaggacttcatcacatgcggcaatgatggcattcgctacacttttaggaatggtttgcagctctttgtttgccatagctgcggcttttttaaccattaccataccgcgaacaaattcaggaatatcactgattttgttgttgctgatatagaagttttcaatcgctctcagagtgtgaacaccatagtaggcatcagctggaacttccctggtacccaacagatcttcttcgatacgaatgttgtttgacatgtgaaccttctttttcaagctgccaatgatttgctttaaacacacagaatatatgtggtttcgaatgtttttcggccgacgattatcccctgcatcgaccgaatacccgagatcatatgctgcttgaggatttctaccgtaacctggatcactttaagtgtcggtttttaccccttaattattaatttgtgaaatggatcaccgctttgggattactaccaaaaatagttgcgcaaacatcttgaaattttgctaatgaccacaatataagctaaacgcgattcgcaacccattcaggtagccgggtttaaccggctgctattacaggagaaacctttgcgctggttaccttttattgccattttcctttatgtctatattgagatttcaatctttattcaggttgctcatgtattgggggtattgctgaccctcgtgctggttatattcacgtcagttatcggtatgtcactggtacgtaaccagggctttaagaatttcgtgctgatgcagcaaaaaatggcggcgggtgaaaacccagcggcggagatgattaaaagtgtttcgctgatcattgccggtttgctgcttttattaccgggctttttcaccgatttcctcggtttgcttcttttattaccgccggtgcaaaagcatctgacagtgaagttgatgcctcatctgcgtttttcccgtatgccaggcggcggttttagcgccgggaccggtggcggtaatacttttgatggtgagtaccagcgaaaggatgatgaccgcgaccgccttgatcataaagacgatcgccaggattaatgtcgaaacgccggattatgtggttatgccattttccggcgtttttcgttttggcagaaacagccataaccccgccagcatgatcagcgcgtagagacttttccagccgaccattgccagtaacagaacgcataatagcccgccaaccaccgccagtagtcgataacgtccttgcaataatttacagcctgccagcatgcataacagataaatcataataaagatgccattggcataaataataagagcgtccagattgatctctaaagcatgaatcaccaatgtgctcaccacgcagcaaccgagcactgcattgagggcattattcgggatatggcgagaagagaggcgtgccaggtagtggtcaggattattttgcgcctgcgaccagaccaggcgggcgaagctctgtatataaatgttgagactggcaaagcaggccagatagccaattacgcaggcaatccataacgctcctacaccgaacaactgcactacaattttgggaagcgatgctgccgccgccatttgttcaccataggcgtcgaagtgtaagacgactaccgtacagccccaatagactaatcctgccagcagcaggccaatcatcaaagcacgaggaaaatcacgctctggatttttaaattccgaggcaagatgggcaaatgcttccagaccgacaaaacaccagaacatcactgataacgcagcgaataacccggtaagttcgatatttcctggcgcagggaaggggatattcgcaggtttgatatcgcccgcccaccagatagcgacaatcagtgcgacgataagcccggcaataactgtttgtagattagcactggaactggcacctcgagtaccgatataccacaccagcgccagcgtaccgagttctgccaacaacagttgcccgctatgccagccaaacattgcctggccgaatccggcagcaatttgtagcgcggcaggcaaacccacgggaatgaccgataaaaacaaccagccggtgactcgctcaagccgcgaaccaaacgccataccgacgaagtgtgcgacgccgcctgcgctgggatagtggcgacccagaatcgcaaacacaatcgcaatcgggaacactaagataatcaaaacgggccacgcccacaggctgttattgcctgctactagcgcagctaacgcaggaacggcaaacacgccagtgcctaataatgacgtcgatagcaggccgatgccctgggccagccccagttcttgtttgagtccactcatgggttgatgtccgattgcgcccaaattttgggcaactgcgtagattttcgatggtagcacaatcagattcgcttatgacggtgatgaagaaatagcgatgaaatgtgaggtgaatcagggttttcacccgattttgtgctgatcagaattttttttctttttcccccttgaaggggcgaagcctcatccccatttctctggtcaccagccgggaaaccacgtaagctccggcgtcacccataacagatacggactttctcaaaggagagttatcaatgaatattcgtccattgcatgatcgcgtgatcgtcaagcgtaaagaagttgaaactaaatctgctggcggcatcgttctgaccggctctgcagcggctaaatccacccgcggcgaagtgctggctgtcggcaatggccgtatccttgaaaatggcgaagtgaagccgctggatgtgaaagttggcgacatcgttattttcaacgatggctacggtgtgaaatctgagaagatcgacaatgaagaagtgttgatcatgtccgaaagcgacattctggcaattgttgaagcgtaatccgcgcacgacactgaacatacgaatttaaggaataaagataatggcagctaaagacgtaaaattcggtaacgacgctcgtgtgaaaatgctgcgcggcgtaaacgtactggcagatgcagtgaaagttaccctcggtccgaaaggccgtaacgtagttctggataaatctttcggtgcaccgaccatcaccaaagatggtgtttccgttgctcgtgaaatcgaactggaagacaagttcgaaaacatgggtgcgcagatggtgaaagaagttgcctctaaagcgaacgacgctgcaggcgacggtaccaccactgcaaccgtactggctcaggctatcatcactgagggtctgaaagctgttgctgcgggcatgaacccgatggacctgaaacgtggtatcgacaaagcagttaccgctgcagttgaagaactgaaagcgctgtccgtaccgtgctctgactctaaagcgattgctcaggttggtaccatctctgctaactccgacgaaaccgtaggtaaactgatcgctgaagcgatggacaaagtcggtaaagaaggcgttatcaccgttgaagacggtaccggtctgcaggacgaactggacgtggttgaaggtatgcagttcgaccgtggctacctgtctccttacttcatcaacaagccggaaactggcgcagtagaactggaaagcccgttcatcctgttggctgacaagaaaatctccaacatccgcgaaatgctgccggttctggaagctgttgccaaagcaggtaaaccgctgctgatcatcgctgaagatgttgaaggcgaagcactggcaactctggttgttaacaccatgcgtggcatcgtgaaagttgctgcggttaaagctccgggcttcggcgatcgtcgtaaagctatgctgcaggatatcgcaaccctgactggcggtaccgtaatctctgaagagatcggtatggagctggaaaaagcaaccctggaagacctgggtcaggctaaacgtgttgtgatcaacaaagacaccaccaccatcatcgatggcgtgggtgaagaagctgcaatccagggccgtgttgctcagatccgtcagcagattgaagaagcaacttctgactacgaccgtgaaaaactgcaggagcgcgtagcgaaactggcaggcggcgttgcagttatcaaagttggtgctgctaccgaagttgaaatgaaagagaaaaaagcacgcgttgaagacgccctgcacgcgacccgtgctgcggtagaagaaggcgtggttgctggtggtggtgttgcgctgatccgcgtagcgtctaaactggctgacctgcgtggtcagaacgaagaccagaacgtgggtatcaaagttgcactgcgtgcaatggaagctccgctgcgtcagatcgtcctgaactgcggcgaagaaccgtctgttgttgctaacaccgttaaaggcggcgacggcaactacggttacaacgcagcaactgaagaatacggcaacatgatcgatatgggtatcctggatccaaccaaagtaacccgttctgctctgcagtacgcggcttctgtggctggcctgatgatcaccaccgagtgcatggttaccgacctgccgaaaaacgatgcagctgacttaggcgctgctggcggtatgggcggcatgggtggcatgggcggcatgatgtaattgccctgcacctcgcagaaataaacaaacccccgggcagaaatgtctgggggtttttcttttggtcatctttctagtataagattcagacacggacgacgcgagtggcgtccagctcattgattatggggaataacatgcacgtaaaatacttagcagggattgtcggtgccgcgctactgatggcgggttgtagctccagcaacgaattgagtgctgccggtcagagtgtacgcattgtggacgagcaaccaggtgcagagtgccagctgattggtactgcgacaggtaagcaaagcaactggctttccgggcaacacggagaagaaggcggttctatgcgcggcgcagcaaacgatctgcgcaaccaggcggctgcaatgggcggtaacgtgatttatggcatcagcagcccgtcgcagggaatgttgtccagttttgtcccgacggatagccagattatcggtcaggtttataagtgcccgaactgatgtgatccagaggctggatacttccagcctcgtagtaaaacagatgagattatttcgcctgtggtgcagttttgctggtggattgaacacgtaagtgatgcagcgcgcgtaagcattgatcctgggttagcggttgggcgttatttgccgctacggtgcgaacatagacctgacatggcacacccgcgagttttttcagtcgggggctgaaatcaagcattcggcgagtgatcgcctccacttctttacccggcgttgcttcacgcgttttcaccactgcgccgctaaattgttcattgccactttcatctttaaagcggtaaagcaccgccagataatggttgaacaagttatgtttccattccggttgggaataggtgtcatattccagattaccatcatcctggcagtcgacatcatataacggcaggaaatctaacagtgaggtaatacgtaacgccagttcacgcatttctgcattattaattgcatgaatgattgctcgcgccagcatttcaatctgcaattcattgaccactaattcgcatttgctgccatcatgtagcgttaatgcgaaattaagaatttcgccctgatcatcggtaagttccagcgtgttaacccgacgattgatatcggcatttttaagctcatcaaccagaatttctgggatattttctgccattttcttaatgactttatcgcgagcttgttcatactgaaggcgtgcagcagcatccagtttatgcttttgatgcagacgactttccagcgcaatcagaaggtcgcgcaattccatggcagacataaagaacaacgattctttattgcgaggttctttaattttcagcgccagtgcaatgaaattattactcttgcgaataacaccggtattaacacccttgatgcttatggccatgtaggttctccctaaccatttctcaattaaataattaattttagtttataagccagataaatgggcttggtagtaatagttgttaaaataacataaatagccgtgctcactctatataaacagaaaagaaaggttaattattggtgttggttatataacgagtaacaacagcaatgtatatgaataattaaaggttatgcaacgggcaaagattaaacttccctgtttaatcagttactgctggcgtagctggagatccagcggcgttttgctgggttcgccgccaatttctcgtgccagtttaggcaccagatatcccgacaccagtgttagcaactcacgcataatctgccgtgcttcgtcatcactcaccataaaatgcgccgcgccctgtactttatcgagcacatgcaggtaatacggcatcacgcccgcatcgaacaacgcattactcaggtttgccagcgtttgcgcgttatcgttcacaccacgtaacagaacgctctggttcagcaaagtaacgcccacccggcgcaacttagccatcgcctgacggaatgtttcatctacctcattggcatggttgatgtgattcaccagcaagatttgcagcgtagaatgagaaaagcgttcaaccagcgcatctgtgatgcgtgccgggatcacaatcggcagacggctgtgaatccgcagacgtttgatatgcgggatggcttccagttgtgtgagcaaccagtccagctcgtgatctttcgccatcagcggatcgccgccggagaaaatcatctcgtccagttccggatgcgcagcaacatactcaagtgcagtctgccagttacgcttgttgccctgattttcggcataggggaagtggcgacggaagcaatagcggcaatttaccgcgcagccgcctttgaccagcaaaagcgcccggttgtggtatttatgcaacaaacctggcactacgctgtgctgttcttccagcgggtcggtggagaatccgggcgcgacaacaaactcatcttgcgaggtaattacctgacgcaaaagcggatcgttcggattgcctttctccatgcgatcgataaatgagcggggcatacgcagggcaaacagctttttggcgctgcgtccggccaacagtttttcgtccgcgtctatattcaaaagacgcagaagttcatcaggatcggtcacaacatcggcaagttgcgttaaccaatcttctctggatggggtatttagggttacaatatgcgccattttgtggcttagctaccaattaacaaatttcagagggccttatggcaacgtactatagcaacgattttcgtgctggtcttaaaatcatgttagacggcgaaccttacgcggttgaagcgagtgaattcgtaaaaccgggtaaaggccaggcatttgctcgcgttaaactgcgtcgtctgctgaccggtactcgcgtagaaaaaaccttcaaatctactgattccgctgaaggtgctgatgttgtcgatatgaacctgacttacctgtacaacgacggtgagttctggcacttcatgaacaacgaaactttcgagcagctgtctgctgatgcaaaagcaattggcgacaacgccaaatggttgctggatcaggcagagtgtatcgtaactctgtggaatggtcagccgatctccgttactccgccgaacttcgttgaactggaaatcgtggataccgatccgggcctgaaaggtgataccgcaggtactggcggcaaaccggctaccctgtctactggcgctgtggttaaagttccgctgtttgtacaaatcggcgaagtcatcaaagtggatacccgctctggtgaatacgtctctcgcgtgaagtaatgcggttgtggtgcggcctgcaggctgcaccatcacttattcaggttagagatgatgaaacgccttatcgttcttgttttgcttgccagcacgctgcttacgggctgtaacaccgctcgaggtttcggcgaagatatcaaacatctcggcaactccatctcccgcgctgccagctaatttttcttctcttccgaaaaatcatcagatttccgtcatttttggcgatgttgtctattattaatttgctataggcaaacataaataacattacctaaaaggaagacgttatggtgaagaagacaattgcagcgatcttttctgttctggtgctttcaacagtattaactgcctgcaacaccacgcgtggcgttggtgaagacatttctgatggcggtaacgcgatttctggcgcagcaacgaaagcgcagcaataagcaataacggtacggcagctgtgtcgtgccgtttgttttttctgcgatagttacataggtaatagttgaaattcccctgccacctggcaaaatatccgttcaaccatcagctttgcaggacgacctgcaaacgcgtcttttcaccggggacggccccaattttccggagcctgatatgtcctggattatcttagttattgctggtctgctggaagtggtatgggccgttggcctgaaatatacccacggctttagtcgtttgacgccaagtgttattaccgtgacggcgatgattgtcagtatggcgctacttgcctgggcgatgaaatcgttaccagtagggacggcttatgccgtgtggacgggtattggcgcagtcggcgcggccatcaccggcattgtgctgctcggtgagtccgctaatccgatgcgcctggcgagtctggcgttaatcgtattggggattattggtctgaaactcagcactcattaactaccgggctgctgtacccaaataaacttactgacatcaaacccttcccgggtcgcgactgccagcatctcctgtttcacttcgtcagaaatggttggcgtgcgggagagtatccacaggtagtcgcggtccgggccgcaaaccagcgcatggcggtattcccgatcgagtgcaataacgttataaccgccatagaaaggaccaaagaatgacactttcagcgcagcgcgagttggtgcgccggtaaagtacgctttcccttcactctgctgccacatttctctgtcagggttatagcctttattaatgacattcaggccgccgtcatcacgcaggctgtatgttgcggtgactttttccagtccacgttcaaagcggtgatcaaaacgggcaatctcataccaggtaccgagataacgtttagcgtcgaaattattcactacggtcacgccacgcggcggcgtaggggaactgcaggcaacgaccagaaatgcagctgtcgctgcggcaacgagagggagcaggcgcataaatgtttccttactggtttttttctaagtgtagatgacagcaaggaaaagcggagaaaaggtccgaaaattcggacccgatgaaattttactgtagagtgttgagaatctgccaggcggcggtaactctcgctggattgggatagtttttgttagccagcatcacgatacccagctctttttctggaataaacgcgacatagctaccaaatccgccggtcgcccccgttttatgtacccatgatgcgcgtactgcaggagttgggggcgtaatcggttttacggggcgtgctgccagtgcaattttattgtcactgccgttaatgatgatgtcaggatttaccggccagtccagcatttcccagcccagaccctgatacatatcgccggtttgccagtagcgagattgtgccagctgtatcccttgttgaagtattttctcattgatatcaaatggttttaaattgctttgcacccagcgggccatatcttcaatggtcgacttcacaccataagcttcagcatctaacgcccctggcgaaacatgtactgccttaccttcgcgatatccccaggcgtagttcttttcttctgcggacggtacattaatccacgtatgattgagtttgagtggctggaagacacgagttttcatcgcctgctcaaaactcaaaccagacggcttcacagccagtgcgccgaacaaaccgatactggagttggcatacagacgttgtgttcctggagcccatgcaggctgccagttttgatagaagcgcagcaagtcgcttgaggatttcacctcatccggcacctgcaatggcaggccgccagcggtgtaggttgcgagatgtaatagtgtgatcccattccactgtttagcggtaagttcaggccagtattttgttgtgggatcgcttaacttgatttcccctcgagcaatagcgtcgccaccaagcacgcccgtaaatgttttgctgaccgaacctaactcaaacaacgtttgctgtgtgacgggctgctttttggcgatgtccgcatagccccaggtaaagtaataaggtttaccctgataaattaccgccaccgccataccggggatcttttgttgatctataagcggggtaattgtgcgatgcacaatatcgttgatttgttgaggggcggcaaatgtggagcaagaggcggtaattaataaggtgcagagcgtcgttttgagcataaggtctggtttccatacaaaacggcccgccataggcgggccggatttacattggcgatgcgttagattgtaacgacaccaatcagcgtgacaactgtcaggatagcagccagaccgtagaaaacccatttacccgcaggtacgtggattttcagatcgtgcatcgcgtggtgcatacggtgtaaaccacaccacagcggcagaacgatcatcaggaacaggaatacgcgaccaatgaagctctgcgcgaacgccagaacgcgctcgtagctcagtgcatcacccggaaacagccctagcggcagcagaataccaaccagcaggatcatcaccggcgcaatgatggcgctccacataccaccggccccgaagaggccccagaataccggttcgtcagaacgctttggatttggattaatcatctcaggctccttaccagtacagggcaacaaacaggattacgatggtggcaaccacagttaccgcccagagacttttgataattggctctggtcccattttttcgtcttttacaatgatattggccgcttttggtgccagctcaaaccaggttttggtgtgcagcagggctgccgccagagtgatcaggttaatgatcatgataaccgggttttgtaaaaagtcgacgaatcccgcccaggcttccgggccatttttcagggcaaacagcccgaaaatcagttcaatgctgaaccacacagccggaaccgccgtgccttcgcgcagcatgtaaaagcgataaaacggcaattttttccaccaggtggacgtcattggccgtacatacggtttacgtttagtcgtcatgttgcactccttagcgtggtttcagggtcgcgataagaaagtctttcgaactttctactttgccctgctgaatggccgcagccggatcgacgtgtttcgggcagacttcggagcagtagcccacgaaagtacagctccatacgccgttctggctgttcaactgcgccatacgctccttcttaccgtggtcgcggctatcttcgttataacgatgcgccagcgtaatggcagccggaccgatgaactctgggttcaggccaaactgcgggcacgcggcgtagcacagaccacagttgatgcaaccggagaactggtgatacttcgccatctgcgccggggtctggatgttagtaccctgatccgcggtgcgggagttgccgatgatgtacggtttgatcgcttccagactttcgatgaagtgggtcatatcgaccaccagatcgcgttcaatcgggaagttagctaacgcttcaaccttcataccgtcggtgtaatcacgcaggaaggttttacatgccagttttggcacgttgttaaccatcatgccgcaggagccacaaatcgccatacggcaggaccagcggtagctcaggtccggtgccaggttgtctttgatgtagcccagcgcatccagtaatgaggtagttgcgtcataaggcacttcatagaatgcgctatgcggtgcggtatcgacttccgggttatagcgcaccacctcaatcttcaggtttttcatctcagccattcgccttctccttcttattggctgcttccgccttatcggctgcatccgcttcgccaccgtaaacacgtttagctggcggcagcgtagtaatcttcacgtcgctgtactccaggcgagtcgtgccatcagcatcgcggaaggcgagggtgtgtttgaggaagttgacgtcgtcacgctcggtgcaaccttcgtccagacgctggtgcgcgccgcgggactctttacgtgccattgcggagtgcgccatacattcagcaacgttcagaccgtggcccagctcaatggtgtagagcaggtcggtgttgaacacgctggaagtgtcggtgatgcgcacgcgcttgaagcgttcctgcagctctgccagcttgtcgatggttttctgcatcagttccggcgtacggtagataccgcagccttcttccatggccatgcccatttcgtcgcggatcttagcccagttttcgccgccatcctggttaaccagatctttcagacgttgttcaacgccagctgcctgcgcttcaattgccgcttcgttgccattaccggcagttgctgcacgctctgtcgcttgttcaccggccagacgaccgaagaccaccagttccgccagcgagttggagcccagacggttcgcaccgtgcagaccaacagaggaacattcacccacggcgaacagacctttaatgcgggtttcacagttctgatcggtttcgataccgcccatggtgtagtgtgcggtcggacgtaccggaatcggttctttaaccggatcgacgccaacgtacgctttcgccagttcgcagatgaacggcagacgttcatgcagttttttctcgccgaggtgacgcaggtcgagataaaccacatcgccacgtggcgtggagatggtgttgcctttacgccattcgtgccagaaggcctgagaaactttgtcgcgtggacccagttccatatatttgtttttcggctcgcccagcggagtttccgggcccatgccgtaatcttgcagataacggtagccatttttgttgaccagaataccaccttcaccgcggcagccttcggtcatcaggataccggaacctggtagaccggttgggtgatactgaacgaattccatgtcacgcagcggaacgccgtggcttagcgccatacccataccgtcaccggtaacgatgccgccgttggtgttgtaacgataaacgcgacccgcaccgccggtagccataacgaccgcgttagcacggatctgcaccagcgtgccttccatcatgttcattgctaccaggccgcgaacatgaccatcatcaaccagaatatccagcacgaaatgttcgtcaaaacgctggatctgcgggaattgcagagaggtctggaacagcgtgtgcagcatatggaagccggtcttatcggcggcgaaccaggtgcgctcgattttcatgccgccgaagcgacgtacgttgacgctaccatccgggcgacggctccatgggcacccccacagttccagttgggtcatttcggttgggcagtggtggacgaaataatccacgacatcctgctcacacaaccagtcgccacccgctactgtatcgtgaaagtgatattcgaagctgtcatgatcctgcgcgacagcggcggagcccccttctgcagcaacggtatggctacgcatcgggtatacttttgagattagtgcgatttttgcatttggatttgcctgcgcggcagcaattgcagcacgtaatcccgcgccaccggcgcctacaatggcaagatcggcttgaaaggtttgcacgacattcctccagattgtttttatcccacagccccgtacttcagggtaagtgcctgaaagttacggtctgcgaacgctattccactgctcctttataggtacaacagtatagtctgatggataagtctgaaatttgacgagatcgatttttttagtgcgcaagagggctaaattatcactgaagatgattaatttaattactaaaccatcagatcgtgctttttttagtcactgcccaccgttgttttattcctgcgtaaaatttgtctcgccgtcgcgttgcgagtagacttcgtgcccttgtcaaaaactggagatttaactatgagcgaaacggcatcctggcagccgagcgcatccattcctaacttattaaaacgcgcggcgattatggcggagatccgtcgtttctttgccgatcgtggagtgctggaggtggagacgccttgtatgagccaggcgacggtaaccgatattcatttggtcccgtttgagacacgtttcgttggccccgggcattcgcaggggatgaatctctggttaatgaccagcccggaataccatatgaagcgcctgctggttgccggttgtgggccggtattccagctgtgccgcagcttccgtaatgaagagatggggcgttatcacaaccctgagttcactatgcttgagtggtatcgaccgcactatgatatgtaccggttgatgaacgaggtggacgatctcttgcaacaggtgctggactgtccggcagcagaaagcctttcttatcaacaagctttcttacgttatctggaaattgacccactctctgccgacaaaacgcaactgcgggaagtggcagcgaaactggatttgagcaacgttgccgatactgaagaagaccgcgacacgcttctacaattgctgtttacctttggcgtagagccaaatattggcaaagaaaaaccgacctttgtgtaccactttccagccagccaggcatcactggcgcaaatcagtaccgaagatcatcgggtcgctgaacgctttgaggtttattataaaggtattgagctggcgaatggtttccatgaattgacggatgcccgtgagcagcaacaacgctttgaacaagataaccgtaagcgcgcggcgcgcggtttgccgcagcaccccattgaccagaatctgattgaagccttgaaagtcggtatgcctgactgttccggcgtggcattaggtgttgatcgtctggtgatgttggcgctgggcgcggagacactggctgaagtcatcgcctttagcgttgaccgggcataattctgaaaaattactgaattaacagcgaagaatggcgtgataagcgccattctgtagcatatgttttcatttttccgctaaataccacaatttaagactggatatttgatatcatccaggtatcaattctgtattggtttttacgctgcccgctcaatgttgggcagtgcagttcagtgggcgcgttttatacacgcgctgaaatgaaggatggtttcatgcctcactcgataaaaaagatgagtctgataggactcatattgatgatctttacttctgtatttggatttgccaatagcccatcggcttattacttaatgggttatagttcgattcccttttatatattttctgcattgttattctttattccattcgccttaatgatggctgaaatgggagctgcttatcgcaaagaagaaggcggtatctattcctggatgaataatagtgtcggaccacgttttgccttcattggtacgtttatgtggttttcctcttatatcatctggatggtgagtacctccgcgaaagtttgggtaccgttctcaacattcctctacggtagcgacatgacccagcactggcatattgccggactggagcctacgcaggtggttggtctgctggcagtggcatggatgattctggtcaccgtcgttgcttcaaaagggattaataaaattgcccgcattactgcggtgggcggtattgcagtaatgtgtctgaatttagtattgctgttagtaagcattactattttgttattaaatggtgggcatttcgcgcaggatattaatttccttgcatcaccgaacccaggttatcagtccggtctggcaatgctatcgtttgtggtatttgccatttttgcctatggcggaattgaagcggttggtggtctggttgataaaacggaaaatccagaaaagaactttgccaaaggtattgtttttgccgctattgttatttcaatcggttattcgctggcaatatttttatggggcgtcagcacaaactggcagcaggtattaagtaatggttccgttaacctcggcaatattacctatgtgctgatgaagagcctcggggtgacgctgggtaacgcactgcatttgtcacctgaagcgtcattgtcgctgggcgtatggtttgcgcgtattaccggactttcgatgttcctcgcttataccggtgcgttctttacactttgctattcaccgctgaaagccatcatccaggggacgccgaaagcattgtggccggaaccgatgacgcgcctgaatgcgatggggatgccgtctatcgccatgtggatgcagtgtgggttggttactgtcttcatcctgctggtttcgtttggtggcggtaccgcatcggcgttctttaacaagctgacgctgatggcgaacgtgtctatgacgcttccttacctgttcctcgcgctggctttcccgttctttaaagcacgtcaggatctcgacagaccatttgtgattttcaaaacgcgtatgtcggcaatgattgcgacagtggttgtcgtactggtggtgacatttgcgaacgtcttcaccatcattcaacctgtggttgaagccggagactgggacagcacattgtggatgattggcggccctgtcttcttctcgctgttagcgatggcgatttactagaactattgcagtcgcatggcgaacaaacctgagttagctctcgactgatcatatgaaatcctgcaactcatcgtctctccggcgatgagttgtcaggaagtaatgcgtatggatgatactctccggggccagtgataactgaagatgatgttaagctgctaaatgagccacgttgacatcatttggcagcttcatgcattacaaacttcccgcctgacgacctttgcccgcagaagttaatgttctccccgtttgcttaccattcaggctttccagacgcatctggaagggcgggaatggcatatcaataccgtgggcatggaatcctgccagaatcagctggtgaatctcatggcgtagtggcatacggtgacccatctcagcggcgtaaatacgcagctcgaaaatttgaatcccctgttgcagatccaccaggaagacttccggtgctgggttatcgattaccagcgagcagcgacgcgctgcggtgagcaggatttccgtcacttcttcactgttggcatcggcaggggccggaatcgtcaacaccacgcgcgtgaccgagtcagagagcgaccagttgataaactgctcggtaataaacgccttgttcggcacgataatttctttgcggtcccagtcgctgatggtggtggcgcgggtgttaatttttgtcacgctaccggtgagatcgcggatcgttaccgtatcgccaatacgaatcggtttttcgaacaggataatcaggccagagataaagttggcgaaaatctcctgtaaaccaaagcccagaccaacaccgagcgcggcgaccagccactgcaatttcgaccactcaataccaatcatcgagaagccgaccagcccgccaatcagcatcagcagatatttggtgatggtggtgatggcgtagcccgtacccggcgttaaatccaggtgctgcagaatcgccagttccagcagcgcgggcaggttgcgcaccagctgcgtggtgatgataaacaccagaatggcaatcagtaccgcaccgagggtaatcggctccaggctttctacgccctgtaccgtggaagtgacatcccacagcgaaatattttcgaggaagccgaaagcggaatggatttctgaccacagcacaatgaccgaaagcagggcgatcaacatcaaaattgagcgcaccagccgcaaggattgcgcactgatggcatcgagatcgacttcgctttcatcgacttcaattgctccttccgggctactgtgatgatgcgcttcctcttcgccacgcgcacgctgcgctaacatctctgcccggcgatgcttcgcccggtcaaacgccagcctgcggcgctggatcagcatccagcggcggataacgtgataaaccaccagtagcaggaaccagatggcaaccgaggtttcaagcctcgctaacagtgcctgcgccgttgccagataacccaccgccgacgccagaatggcaaccagcggtgcgccaatcatcatgttccacagcatatggttggtaatgttgtcgccgctgccttctttgttgagatacagcgggatcccggcctttttcaggctgagagtgaccaccgccagcgcaccgcaaatgaggataaagcaaagccgtcccagcgaaccggagaattcacggtcgtcgaggttatcgaacatcatcagcgccataatcagcggcacaataagcccgatgctcatcaggtagtaacgcatcccacgggaaacacgttcgcgcggccagccaaaatgagcgataaacaagccgttcgggcgagcaaaggtggcgcaaatcatcactacccacagcagcggcacggtggctgttacgccatcaccaatcgcgaccgccagcggataaggccacgcctcgcgcaagccgtaacccagcgtcatccacagcacaggcagcggtgacgcgacgagaatcgaccagaaaagagtgcgtaacgtcagccagaagtgatcctgagtcactttgccgactttcgccgccgaacgttcaagaaaacgggtgaaatagcggcgcgagtaaatactgcaaccgaccagaatcaacgcgccaaacagcggcaaaatcgtctctttactggtcagcatcatcacactggctttgcccaactgactgaaggtgtccagcgaaatgagacgacgcagatcctgggcgatttccagcggccaggcgatggtcatcgggcgcacgtcagaggtccagaacagatagcggtgcgtcgcttcgttcacctctttcagcgcatcctccagttgcccgttggagactttcagcttggtcagctccagcagtagcgtgtcgccaccctgcaacaatgagttcagcaactcacgctgagtgcgtagctgtgcttccagaatacggttttgctcagcggtcagtggctgaccgtcggcctgatggatttgccgtagcagcggctgtttattaagcagatcctcataacgtaaccgttgcacacgtaactgcgccatttcggtatcaagctgttgtggttttggcatttccggtagccgtgccacctgcgcccgcaacgcttcgccgagcaggttagatgatcccagccattgcgactgttcacgcagcgtattcaacgcctgccggacctgtaacgtctggctggcagcctgacgctgttgcgaggcaacgagatccatccgctgcgcctgttgattcagcgccgccgatagttcgcggttaattttaaactgggcgacgatatcttttggcaaatcggcgctactttccgccagttgctcggtactttccagcgcccgttccgcttccagttggcgttgactattcaactggttgcgtagtgcttgcaaatatgcatccagctgctggctctctttttccgccagctcagagcgcaagcgcgctaattcctggcggttattggcagatagctgcgccagctccagttcatcaacgagcgctttcagacgtgcggagtcagactgcaacgcgaaattttgtgcctgattgagcggggtattgccggtaagcgtccccaggcggcgctcgatttcattcaactgacggcgggcatcggtttgctgttgcggcagttgattcagcgaatcggcaatctcgcgggcgcgctcctgctcttgctgggcctgacggcttttatccagcaactgactgctgatctggagaatttcctgattcagcgcatcgttagacattcccggcgacacgctgcgtggctcgtcacgcatgttgtttaactgcgcgcgcagagtggcggaaattttcggataattatcaatgacttcttgatattgcttgatgcgctcaagggaaccttttcgttcctcaagcgcatttaaggcagactggagcgcctctacgacttccggctgcgcgggtttcgccgcttttgcctgctccagttcctgggtgatttgtttgctatcgggggccgtcgcggcgtacgccccccaactgaggcaccaggccatcagaaaagtgataatcaggcgcacgtcagcgtttcctttgatggattagacctggtcttttttgtcgtcaaccaatgggctggcgtcgtgttctgcttcgatctcttcagcaggaagcggggctggttcagcgtctggcgtaacaaaggtttcggtagatactgccagcggctggccaattttcgtgacagacaggctttccagttgctcaaccaggttcactttacctggtgcaaacaggttgataacggtagagccaagtttaaagcgacccatttcctggcctttcagcaatgccacagaaccgtcgttttccccggcaggccaggtccagcgcttgatgatgccttcgcgcggcggcgtaatggtgcccgcccagaccgtctcaatgctgcctacaatcgtcgcaccgaccagaatctgcgccatcgggccaaattcggtatcgaacaggcagatcacgcgttcgttacgggcaaacagattcggcacgttctgagccgtgagatggttaacggagaagagatcgcccggcacgtagatcatttcacgcagaataccgttgcacggcatgtgtacgcggtggtagtcacgtggggagaggtaagtggtcacaaacgtaccgttacggaagagatccgccatcagatagttgcctgccagcagggcttcgaggctgtagttgtggcctttggcttgcaggattttatcttcttcgattttacccaactggctgataacgccatcggcaggcataaccagtacattcggatcggtatcgattgggcgtacttcgtcacgcagcggacggacaaagaattcgttaaaggtgcggtagctggcggtgtccggcttttgcgcctctttcatgtcgaccttgtagtatttaacgaacagatcgataaccagttttgtcagccatcctgcccgcttgcttgcgccccaacccgccaggcgagtaagccatagtttcggcagaatgtactgtagcgaaagtttaaatgaatttaacaaggtagcctccaggccattgttttgtcgttcctgatccggcctacatgccggatcctgaaaaaaaggggacgattctaacgacggttagcttaattgtcagtcatccgtatcagaaaagtttttacgcgtttttacctgcgccatgctttccagaatacggtgatagttttcgaaacgggtttccgcgattttcccttcctcaaccgcttcccggatagcgcagcccggatcggtatcgtgtttgcaatcgcgatatttacacagacctaaatagtcatggaattcgacaaagccctgagtgatttgttccggctccaggtgccagagaccaaactcacgcacacctggggaatcaatcacatcaccgccgtgcgggaagtgatacagtcgtgcggcggtcgtggtgtgctgaccaagccccgagttgtcagagacatcgttggtcaggatctctttttgcagccccagcaacgcgttcagcaggctggatttgccaacgccagactgcccggcaaaaatgctgatgcgcccggtcaacgcctcttccagcggtttcagcccatcctgagtatgactggaaaccatcaatacgcgataaccgatattgcggtagatatccatctgctcgttgacgaactccatgccttcgtcgtccagcaggtctatcttgttgagcacaataatcggctcaatctgcaaggtttcgcaggccaccaggtaacggtcgataatattgagcgacagctccggcaaaatggcggagacaatgacaatctggtcgatgttggcggcaataggtttcacgccatcgtagaagtccgggcgcgttaacactgaagtgcgctcatgcaccgcttccacgatccctttgacatttacgccttccgccgccggtttacccggacgccagactacgcggtcgccggtcaccaacgaacggatggtacggcgaatattgcagcggtgaacgtcgccatcggcggattccacatcagcgtgcataccaaagcggctgatgacgataccttcatcaggctcgccaaacagattgtcgtcgtagtcgggcttctccttagacgttttaagacgacgctggtgattggcgttcacgcggcgctgctggcctttggagagtttatttttactcaatcgtacagactcctggtcgcccctgatgggcaaaacatctatgatacacgcaattgtggatcaatatagtcactgtgaatgggtggaaaatagcatgagtgccaatgaaaacaacctgatttggatcgatcttgagatgaccggtctggatcccgagcgcgatcgcattattgagattgccacgctggtgaccgatgccaacctgaatattctggcagaagggccgaccattgcagtacatcagtccgatgaacagctggcgctgatggatgactggaacgtgcgcacccataccgccagcgggctggtagagcgtgtgaaagcgagcacgatgggcgatcgtgaagctgaactggcaacgctcgaattcttaaaacagtgggtgcctgcgggaaaatcgccgatttgtggtaacagcatcggtcaggaccgtcgcttcctgtttaaatacatgccggagctggaagcctacttccactaccgctatctcgatgttagcaccctgaaagagctggcgcgccgctggaagccggaaattcttgacggctttaccaagcaggggacgcatcaggcgatggatgatatccgtgaatcggtggcggagttggcttactaccgcgagcattttatcaagctgtaaaatttttcctggtcacgtaagcgccggaatccacttgcggcggcgtgattttgacgctaaattgaacgtcttgctgataatttcagcacttgagataaaaactcaaaaaaaattttttaggggggttgcagagggaaagatttctcgtataatgcgcctcccgtaacgacgcagaaatgcgaaaattacgaaagcaaaattaagtagtacgcgggaatagctcagttggtagagcacgaccttgccaaggtcggggtcgcgagttcgagtctcgtttcccgctccaaaatttgaaaagtgctgtaaagcacagaccacccaagcgggaatagctcagttggtagagcacgaccttgccaaggtcggggtcgcgagttcgagtctcgtttcccgctccaaaatttgaaagtgctgtaaagcacagaccacccaagcgggaatagctcagttggtagagcacgaccttgccaaggtcggggtcgcgagttcgagtctcgtttcccgctccaaattcttctctcaataaaatatccacagcgacgcgatgcgttattgctggtttttgatgtctctgacagactcttgtaaacagagttatccacagcctcaggccgtaatcttaatttcaaagaaacttcgcacggtgaatagtatttttttaacctattgatagataagttaaaaattaagatttcgttttgtcgtatcgatcacttaacgattttttccggcttgaattgcaatgcgtttttatttttattcacaagctgtggatgaatcaggcgtcacgcggtaaccctttttcaatcacccgaaccagacgctgttttttcggtaattgcacttcgaccacgcacgcatttcgcctctcgatttgctgcgcaatcgcccacgctatgtgctcatcaagaagtgggtgctcacctttacgactttccagcgctgtcaaaatcgtttcatcccagggggcattgcctaatgctacggcgatattacgcagccaacgcaggtgacctatacggcgaatcgccgaaccttccgtgacttttaaaaacttctcttcactccaggcgaataactcaatgagttccggtgcgtgtagcggcttacgcgggctgaaatcgtcttctgtagtgagttgcgaatagcgattccacgggcagataagctggcagtcatcgcaaccgtaaatacggtttcccattaacggtcgcaactcttccgggatcgccccttccagttcgatggtgagataagagatacagcggcgagcatcgacggtatatggctcgacgatggctccggtcgggcaaatcgtcatacaggccacgcatttaccgcatccttcctcgactggttgatccacaggcagcggaatatcgaccagcaattcgcctaaaaagaagaacgaaccggcctcgcgattgaggataagtgagtgcttacctgtccagccaagacctgctttttcagctaacgggcgctcgagaataggcgcagaatcgacaaacggtctaaaattcagcgaaacacaatgttgctgaatcatctcgcccagctttttgagtcggttgcgcagaagcttgtgatagtcacggcccagcgcataacggctaacatagccgagtttgggatttttcagtgtgctggcaaatgcggcgttagcaggaaggtaattcatccgcacgctgatcacgcgcagcgtaccgggcaataattcgtgaggacgagcacgcagcataccgtaacgcgccatccagtccatttcgccgtggtattgtttgtccagccatgcttgcagtttgggctcggacgcgctgagatcggtatcggtaatacctacctgctgaaagcccagttccagcccccactgtttaatattttgcgctaattgattgagatcgaggggctctgacatgacggaccatacaatgaagaaaaaccccgtaagtataccacacaccgtctggtatgccgacgatatccgccgcggagaacgcgaggcggcagatgcgctggggctcacactctatgagctgatgcttcgcgctggcgaagccgcattccaggtgtgtcgttcggcttatcctgacgcccgccactggctggtgctgtgcggtcatggtaataacggcggcgatggctacgtggtcgcgcggctggccaaagcgatcggtattgatgtcacgctgctggcccaggaaagtgacaaaccgttgccggaagaggccgcgctggcacgcgaagcatggttaaacgcgggaggcgagatccatgcttcgaatattgtctggcccgaatcggtagatctgattgttgatgcgctgctcggcaccggcttgcagcaagcgccccgcgaatccattagccagttaatcgaccacgctaatactcaccctgcgccgattgtggcggttgatatcccttccggccttctggctgaaaccggcgctacgccaggcgcggtaatcaacgccgatcacaccatcacttttattgcgctgaaaccaggcttgctcactggaaaagcgcgggatgttaccggacaactgcattttgactcactggggctggatagctggctggcaggtcaggagacgaaaattcagcggttttcggcagaacaactttctcagtggctgataccgcgtcgcccgacttcgcataaaggcgatcacgggcggctggtgattattggtggcgatcacggcacggcgggggctattcgtatgacgggggaagcggcgctgcgtgctggtgctggtttagtccgagtactgacccgcagtgagaacattgcgccgctgctgactgcacgaccggaattgatggtgcatgaactgactatggactctcttaccgaaagcctggaatgggccgatgtggtggtgattggtcccggtctgggccagcaagagtgggggaaaaaagccctgcaaaaagttgagaattttcgcaaaccgatgttgtgggatgccgatgcattgaacctgctggcaatcaatcccgataagcgtcacaatcgcgtgatcacgccgcatcctggcgaggccgcacggttgttaggctgttccgtcgctgaaattgaaagtgaccgcttacattgcacccaacgtctggtacaacgttatggcgggcgtagcggtgctgaaaggtgccggaaccgtggtcgccgcccatcctgacgctttaggcattattgatgccggaaatgcaggcatggcgagcggcggcatgggcgatgtgctctctggtattattggcgcattgcttgggcaaaaaatgagcccttatgatgcagcctgtgcgggctgtgtcgcgcacggtgcggcagctgacgtactggcggcgcgttttggaacgcgcgggatgctggcaaccgatctcttttccacgctacagcgtattgttaacccggaagtgactgataaaaaccatgatgaatcgagtaattccgctccctgatgagcaggcaacattagacctgggcgagcgggtagcgaaagcctgcgatggcgcaaccgtaatctatctgtatggcgatttaggtgcaggtaaaaccacctttagccggggctttttacaggctctgggtcatcagggtaatgtcaaaagccccacttatacgctggtcgaaccctatacgctcgacaatttactggtttatcactttgatttgtaccgccttgccgatcccgaggagctggagtttatggggatccgcgattattttgccaacgatgccatctgcctggtggagtggccacaacaaggtacaggtgttcttcctgacccggatgtcgaaatacacattgattatcaggcacaaggccgtgaggcgcgcgtgagtgcggtttcctctgcgggtgaattgttgctggcgcgtttagccggttaacctttgaaaggtggcgggatgatgtatcgcatcagaaattggttggtagcgacgttgctgctgctgtgcgcgccggtgggtgccgcgacgctctctgatattcaggtttctaacggtaatcaacaggcacggataacgttgagttttattggcgatcctgattatgcgtttagccatcaaagcaaacgcaccgtggcgctcgatatcaaacaaacgggggtaattcaggggctgccgttgttgtttagcggcaataatctggtgaaggcgattcgctctggaacgcctaaagatgcacaaacgctacggctggtggtcgatctcaccgaaaacggtaaaaccgaagcggtgaagcggcagaatggcagctattacactgttgtctttacgattaacgccgatgcgccgccatcgcctccgccaatggttgcgaaacgcgttgaaacgcctgcggttgtcgcaccgcgcgtcagcgaaccggcgcgcaatccgtttaaaacggaaagtaaccgcactacgggtgttatcagcagtaatacggtaacgcgtccggcagcgcgcgcgacggctaacacaggcgataaaattatcatcgctattgatgccggacacggcggtcaggaccctggcgctatcggccctggtggtacacgggagaaaaatgtcaccatcgccattgcgcgtaaattacgtaccttgctcaataacgatccgatgtttaagggcgttttaacccgtgacggggattattttatctcggtgatggggcgcagtgatgtggcacgtaagcaaaacgccaatttccttgtgtcgattcatgccgatgccgcaccaaaccgtagtgccaccggtgcctctgtatgggtgctctctaaccgtcgcgccaacagcgaaatggcaagctggctggagcagcacgagaaacagtcggagctactgggcggagcgggcgatgtgctggcgaacagtcagtctgacccctatttaagccaggcggtgctggatttacagttcggtcattcccagcgggtagggtatgatgtagcgaccagtatgatcaatcagttgcaacgcattggcgaaatacataaacgccgaccagaacacgcgagtctcggcgttctgcgttcgccggatattccgtcagtactggtcgaaaccggttttatcagtaacaacagcgaagaacgtttgctggcgagcgacgattaccaacaacagctggcagaagccatttacaaaggcctgcgcaattacttccttgcgcatccgatgcaatctgcgccgcagggtgcaacggcacaaacggccagtacggtgacgacgccagatcgcacgctgccaaactaaggacgattgatgccaattcaggtcttaccgccacaactggcgaaccagattgccgcaggtgaggtggtcgagcgacctgcgtcggtagtcaaagaactggtggaaaacagcctcgatgcaggtgcgacgcgtatcgatattgatatcgaacgcggtggggcgaaacttattcgcattcgtgataacggctgcggtatcaaaaaagacgagctggcgctggcgctggcgcgtcatgccaccagtaaaatcgcctctctggacgatctcgaagccattatcagtctgggctttcgcggtgaggcgctggcgagtatcagttcggtttcccgcctgacgctcacttcacgcaccgcagaacagcaggaagcctggcaggcctatgccgaagggcgcgatatggacgtgacggttaaaccggcggcgcatccggtgggaacgacgctggaggtgctggacctgttctacaacaccccggcgcggcgcaaattcctgcgcaccgagaaaaccgaatttaaccatatcgatgaaatcatccgccgcattgcgctggcgcgtttcgacgtcactatcaacctgtcgcataacggcaaaattgtacgccagtaccgcgcagtgccggaaggcgggcaaaaagaacggcgcttaggcgcgatttgcggcaccgcttttctcgaacaagcgctggcgattgaatggcaacacggcgatctcacgctgcgcggctgggtggccgatccaaatcacactacgcccgcactggccgaaattcagtattgctacgtgaacggtcgcatgatgcgcgatcgcctgatcaatcacgcgatccgccaggcctgcgaagacaaactgggggccgatcagcaaccggcatttgtgttgtatctggagatcgacccgcatcaggtggacgtcaacgtgcaccctgccaaacacgaagtgcgtttccatcagtcgcgtctggtgcatgactttatctatcagggcgtgctgagcgtgctacaacagcaactggaaacaccgctaccgctggacgatgaaccacaacctgcaccgcgtgccattccggaaaatcgcgtggcggcggggcgcaatcactttgctgaaccggcagttcgtgagccggtagctccgcgctactctcctgcgcccgcctcaggcagtcgtccggctgccccctggccgaatgcgcagccaggttaccagaaacagcaaggtgaagtgtatcgccagcttttgcaaacgcccgcgccgatgcaaaaaccaaaagcgccagaaccgcaggaacctgcacttgcggcgaacagtcagagttttggtcgggtactgactatcgtccattccgactgtgcgttgcttgagcgcgatggcaacatttcacttttatccttgccagtggcagaacgttggctgcgtcaggcacaattgacgccgggtgaagtgccagtttgcgcccaaccgctgcttattccgttgcggctaaaagtttctggcgaagaaaaatcggcattagaaaaagcgcagtctgccctggcggaactgggtattgatttccagtccgatgcgcagcatgtgaccatcagggccgtgcctttacccttacgccaacaaaatttacaaatcttgattcctgaactgataggctacctggcgaagcagtccgtattcgaacctggcaatattgcgcagtggattgcacgaaatctgatgagcgaacatgcgcagtggtcaatggcacaggccataaccctgctggcggacgtggaacggttatgtccgcaacttgtgaaaacgccgccgggtggtctgttacaatctgttgatttacatccggcgataaaagccctgaaagatgagtgatatcagtaaggcgagcctgcctaaggcgatttttttgatggggccgacggcctccggtaaaacggcgttagccattgagctgcgtaaaattttaccagtagagttgataagcgttgattctgcccttatttacaaagggatggatatcgggacggcgaagccgaacgctgaagagttactcgccgcgccgcaccgattgctgaatattcgcgatccgtcgcaggcttactcggctgctgattttcgccgcgatgcgctggcggaaatggccgatatcaccgcggcggggcggatcccactgttagtgggcggtacgatgttgtatttcaaggcattgctggaagggttgtcgccgctaccgtcggcagacccggaagtacgggccagaattgagcaacaggcggcagagcaaggttgggagtcattgcatcgtcaacttcaggagatcgatccggttgcggcagcaaggattcatccaaatgatccacaaaggctttcccgggcactggaagtttttttcatttcgggtaaaactttaacggaactgacgcaaacgtcaggagacgctctaccgtatcaggtgcatcagttcgccatcgccccggcgagccgtgaactgctccatcaacgaattgagcagcgttttcatcagatgttggcttcaggttttgaagcagaagtccgggcgctttttgcccgaggagatttgcatacggatttgccttccattcgttgcgtgggttatcgccagatgtggtcttaccttgaaggcgaaatctcatacgatgaaatggtttatcgaggtgtttgcgccacgagacagttggcgaagcggcagataacctggctgcgtggttgggaaggggttcactggcttgacagtgaaaaaccagaacaggcgcgtgacgaagtattacaggttgttggtgctatcgcaggctgaatgtgtacaattgagacgtatcgtgcgcaattttttcagaatcgaaaggttcaaagtacaaataagcatataaggaaaagagagaatggctaaggggcaatctttacaagatccgttcctgaacgcactgcgtcgggaacgtgttccagtttctatttatttggtgaatggtattaagctgcaaggacaaatcgagtcttttgatcagttcgtgatcctgttgaaaaacacggtcagccagatggtttacaagcacgcgatttctactgttgtcccgtctcgcccggtttctcatcacagtaacaacgccggtggcggtaccagcagtaactatcatcatggtagcagcgcgcagaatacttccgcgcaacaggacagcgaagaaaccgaataaggtttcgggctgtttttttacacggggagccagcgatcctgcgttccccgctgatctatttagagggttatacgcttgtttgaccgttatgatgctggtgagcaggcggtactggtacacatctattttacgcaagacaaagatatggaagacctccaggagtttgaatctctggtctcttccgccggtgtcgaagcattgcaggtgattaccggtagccgtaaagcgccgcacccaaagtattttgtaggtgaaggtaaagcagttgaaattgcggaagctgtcaaagcgacgggtgcttcggtcgttctttttgaccatgccctgagcccggcgcaagagcgtaacctggaacgtttgtgcgagtgtcgtgtcatcgaccgcaccggccttattttagatattttcgcccaacgtgcgcgtacccatgagggtaagttgcaggttgagctggcgcagttgcgccatctggctacgcgcctggtgcgtggctggacccaccttgaaagacagaaaggcgggattggtttgcgtggtccgggtgaaacccagctcgaaaccgaccgtcgtttgttgcgtaatcgcatcgtgcagatacagtcgcgcctggaaagagttgaaaagcagcgtgagcaggggcggcaatcgcgtatcaaagccgacgttcctactgtttcgctggtgggatataccaacgccggtaaatctactcttttcaatcgcatcaccgaagcgcgggtctacgcggcagaccagttgtttgccaccctcgacccgacgttgcggcgtattgacgttgcggatgtcggtgaaaccgtgttggcagataccgtagggtttattcgccacctgccgcacgatctggtggcggcatttaaagccacgttacaagagacgcggcaagccacattgctgctgcacgtcattgacgcggcggatgtgcgtgtacaagaaaacatcgaagcggtgaatacggttcttgaagagattgatgctcacgagatcccaaccctgctggtgatgaacaagatcgatatgctggacgatttcgaaccgcgtattgacagagatgaagagaacaaaccgatccgtgtctggctttctgcgcagaccggagcggggataccacagctttttcaggctttgacggagcgtctttccggcgaggtggcgcagcatacattgcgtctgccgccgcaggaagggcgcctgagaagtcgtttttatcagcttcaggcaatagaaaaagagtggatggaggaggacggcagcgtaagtctgcaagttcgtatgccgatcgttgactggcgtcgcctctgtaaacaagaaccggcgttgatcgattacctgatctaacggcgtagcgtctgaagcgtggagtcatatcctctggcgtcgaaagacaacagggatcaccgcataacaaatatggagcacaaacatggcgtggaatcagcccggtaataacggacaagaccgcgacccgtggggaagcagcaaacctggcggcaactctgagggaaatggaaacaaaggcggtcgcgatcaagggccacctgatttagatgatatcttccgcaagctgagcaaaaagctcggtggtctgggcggcggtaaaggcaccggatctggcggtggcagttcatcgcaaggcccacgcccgcagcttggcggtcgtgtcgttaccatcgcagcggcagcgattgtcattatctgggcggccagtggtttctataccattaaagaagccgaacgtggcgtggtaacacgctttggtaaattcagccatctggttgagccgggtctgaactggaaaccgacgtttatcgacgaagtcaaaccggtgaacgtggaagccgtgcgtgaactggcagcttctggtgtgatgctgacgtcggacgagaacgtagtgcgcgttgagatgaacgtgcagtaccgcgtcaccgatccggaaaaatatctgtatagcgtgaccagcccggatgacagtctgcgtcaggctaccgacagcgccctgcgcggggttatcggtaaatacaccatggaccgtattctgacggaaggtcgtaccgtgattcgtagcgatacccagcgcgaactggaagagacgattcgtccgtatgacatgggcatcacgctgctggacgtcaacttccaggctgctcgtccgccggaggaagtaaaagcggcgtttgacgatgcgattgccgcgcgtgaaaacgaacagcaatacattcgtgaagcagaagcgtataccaacgaagttcagccgcgtgcgaacggtcaggcgcaacgtatcctcgaagaggcacgtgcgtacaaggcccagaccatcctggaagctcagggtgaagtggcgcgctttgctaaacttctgccggaatataaagctgcgccggaaattactcgcgagcgtctgtatatcgagacgatggaaaaagtgttgggtaacacccgcaaagtgctggttaacgacaaaggtggcaacctgatggttctgccgttagaccagatgctgaaaggtggtaacgcccctgcggcgaagagcgataacggtgccagcaatctgctgcgtctgccgccagcctcttcctccacaaccagtggagcaagcaacacgtcgtccaccagtcagggcgatattatggaccaacgccgcgccaacgcgcagcgtaacgactaccagcgtcagggggaataacgatgcgtaagtcagttatcgcgattatcatcatcgtgctggtagtgctttacatgtctgtctttgtcgtcaaagaaggtgagcgcggtattacgctgcgttttggtaaggtactgcgtgacgatgacaacaaacctctggtttatgagccgggtctgcatttcaagataccgttcattgaaacggtgaaaatgctcgacgcacgtattcagaccatggacaaccaggccgaccgctttgtgaccaaagagaagaaagacctgatcgtcgactcttacatcaaatggcgcatcagcgatttcagccgttactatctggcaacgggtggtggcgacatttcgcaagcggaagtgctgttgaaacgtaagttctctgaccgtctgcgttctgaaattggtcgcctggacgtgaaagacatcgtcaccgattctcgtggtcgtctgaccctcgaagtacgtgacgcgctgaactccggttctgcgggtacagaagatgaagttactacccctgcagcagataacgccattgccgaagcggcagagcgcgtaacggctgagacgaagggcaaagttccggtcatcaatccgaacagtatggcggcgctgggtattgaagttgtcgatgtgcgaattaagcagatcaacctgccgaccgaagtgtctgaagcgatctacaaccgtatgcgcgccgagcgtgaagcggtagcgcgtcgtcaccgttcacaaggtcaggaagaagcggaaaaactgcgcgcgactgccgactatgaagtgaccagaacgctggcagaagctgagcgtcagggccgcatcatgcgtggtgaaggcgatgcagaagcagccaaactgtttgctgatgcattcagtaaagatccggacttctacgcatttatccgtagcctgcgtgcttatgagaacagcttctctggcaatcaggacgtgatggtcatgagcccggacagcgatttcttccgctacatgaagacgccgacttccgcaacgcgttaatataacgactgcggtacaggtcaataaagccaccgcatcctcagggatgtcggtggttttctttttctataaggataatgaatgaattcgacaatctggctggcgcttgccctggttttggtactggaaggtttagggccgatgctttacccgaaggcatggaagaagatgatctctgcaatgaccaatttgcccgataatattttacgtcgttttggcggtggacttgtggttgcgggcgttgtggtctactacatgttgaggaaaacgattggctgaacaaaaaacagactgatcgaggtcatttttgagtgcaaaaagtgctgtaactctgaaaaagcgatggtagaatccatttttaagcaaacggtgattttgaaaaatgggtaacaacgtcgtcgtactgggcacccaatggggtgacgaaggtaaaggtaagatcgtcgatcttctgactgaacgggctaaatatgttgtacgctaccagggcggtcacaacgcaggccatactctcgtaatcaacggtgaaaaaaccgttctccatcttattccatcaggtattctccgcgagaatgtaaccagcatcatcggtaacggtgttgtgctgtctccggctgcgctgatgaaagagatgaaagaactggaagaccgtggcatccccgttcgtgagcgtctgctgctgtccgaagcatgtccgctgatccttgattatcacgttgcgctggataacgcgcgtgagaaagcgcgtggcgcgaaagcgatcggcaccaccggtcgtggtatcgggcctgcttatgaagataaagtggcacgtcgcggtctgcgtgttggcgaccttttcgacaaagaaaccttcgctgaaaaactgaaagaagtgatggaatatcacaacttccagttggttaactactacaaagctgaagcggttgattaccagaaagttctggatgatacgatggctgttgccgacatcctgacttctatggtggttgacgtttctgacctgctcgaccaggcgcgtcagcgtggcgatttcgtcatgtttgaaggtgcgcagggtacgctgctggatatcgaccacggtacttatccgtacgtaacttcttccaacaccactgctggtggcgtggcgaccggttccggcctgggcccgcgttatgttgattacgttctgggtatcctcaaagcttactccactcgtgtgggtgcaggtccgttcccgactgaactgtttgatgaaactggcgagttcctctgcaagcagggtaacgaattcggcgcaactacgggtcgtcgtcgtcgtaccggctggctggacaccgttgccgttcgtcgtgcggtacagctgaactccctgtctggcttctgcctgaccaagctggacgttctggatggcctgaaagaggtgaaactctgcgtggcttaccgtatgccggatggtcgtgaagtgactaccactccgctggcagctgacgactggaaaggtgtagagccgatttacgaaaccatgccgggctggtctgaatccaccttcggcgtgaaagatcgtagcggcctgccgcaggcggcgctgaactacatcaagcgtattgaagagctgaccggtgtgccgatcgatatcatctctaccggtccggatcgtactgaaaccatgattctgcgcgacccgttcgacgcgtaattctggtacgcctggcagatattttgcctgccgggctaacagtgtgatacattgctgtgtcgggtaagccattacgctatccgacacagtgttaaatcctcgcttttttccttccccgaactgaaataaattagcgacacagcttgtggctggtttatcatcaatataaatgtattttttcccgatttcccttttgaggttgatgtgcagttaacgagtttcactgattacggattacgtgcgctgatctacatggcgtcattgccagaagggcggatgaccagtatttctgaagtgactgacgtctacggcgtctcccgtaatcatatggtcaaaataatcaatcaacttagtcgtgccggctacgtgactgctgttcgtggaaaaaatggcggcattcgcttgggtaaaccggcgagtgcaatacgtattggtgatgtggtgcgcgagctggagcccttatcgctggtgaattgcagcagtgagttttgccacattacacctgcctgtcggttgaaacaggcgctttctaaggccgtgcaaagttttcttacggaactggataactacacgcttgccgatttggttgaagagaatcaaccgctttataaattattgctggtggagtgacgaaaatcttcatcagagatgacaacggaggaaccgagatgtcacaagatcctttccaggaacgcgaagctgaaaaatacgcgaatcccatccctagtcgggaatttatcctcgaacatttaaccaaacgtgaaaaaccggccagccgtgatgagctggcggcagaactgcacattgaaggcgaagagcagcttgaaggcctgcgtcgccgcctgcgcgcgatggagcgcgatggtcaactggtcttcactcgccgtcagtgctatgcgctgccggaacgcctcgacctggtgaaaggtatcgttattggccaccgtgatggctacggctttctgcgagttgaagggcgtaaagatgatttgtatctctccagcgagcagatgaaaacctgcattcatggcgatcaggtgctggctcagccgctgggcgctgaccgtaaaggtcgtcgtgaagcgcgtattgtccgcgtactggtgccaaaaaccagccagattgttggtcgctacttcaccgaagcgggcgtcggctttgtggttcctgacgatagccgtctgagcttcgatatcttaatcccgcccgatcagatcatgggcgcgcggatgggctttgtggtggtggttgaactgactcaacgcccgactcgccgtaccaaagcggtgggtaaaatcgtcgaagtgctgggcgacaatatgggcaccggcatggcggttgatatcgctctgcgtacccatgaaattccgtacatctggccgcaggctgttgagcaacaggttgccgggctgaaagaagaagtgccggaagaagcaaaagtgggccgtgtcgatctgcgcgatttaccgctggtcaccattgatggcgaagacgcccgtgactttgacgatgcagtttactgtgagaaaaaacgcggcggcggctggcgtttatgggtcgcgattgccgacgtcagctactatgtgcgtccgccaacgccgctggacagagaagcgcgtaatcgtggtacgtcggtgtacttcccttcgcaggttatcccgatgctgccggaagtgctctctaacggcctgtgctcgctcaacccgcaggtagaccgcctgtgtatggtgtgcgagatgacggtttcgtcgaaaggccgcctgactggctacaaattctacgaagcggtgatgagttctcacgcgcgtctgacctacaccaaagtctggcatatactgcaaggcgatcaggatctgcgcgagcagtatgcgccgctggttaagcatctcgaagagttacataacctctataaagtgctggataaagcccgtgaagaacgcggtgggatctcatttgagagcgaagaagcgaagttcattttcaacgctgaacgccgtattgaacgtatcgaacagactcagcgtaacgacgcccacaagttaattgaagagtgcatgattctggcgaatatctcggcggcgcgtttcgttgagaaagccaaagaaccggcactgttccgtattcacgacaagccgagcaccgaagcgattacctctttccgttcagtgctggcggagctggggctggaactgccgggcggtaacaagccggaaccgcgcgactatgcagagttactggaatcggttgccgatcgtcctgatgcagaaatgctgcaaaccatgcttttgcgctcgatgaaacaggcgatttacgatccggaaaaccgtggtcacttcggtctggcattgcagtcctatgcgcactttacttcgccgattcgtcgttatcctgacctgacgttgcaccgcgccattaaatatctgctggcgaaagagcaggggcatcagggcaacaccactgaaaccggcggctaccattattcgatggaagagatgctgcaactgggtcagcactgttcgatggcggaacgtcgtgccgatgaagcaacgcgtgatgtgtctgactggctgaagtgtgacttcatgctcgaccaggtaggtaacgtctttaaaggcgtaatttccagcgtcactggctttggcttcttcgtccgtctggacgacttgttcattgatggtctggtccatgtctcttcgctggacaatgactactatcgctttgatcaggtagggcaacgcctgatgggtgaatccagcggccagacttatcgcctgggcgatcgcgtggaagttcgcgttgaagcggttaatatggacgagcgcaaaatcgactttagcctgatctccagcgaacgcgcaccgcgcaacgtcggtaaaacggcgcgcgagaaagcgaaaaaaggcgatgcaggcaaaaaaggcggcaagcggcgtcaggtcggcaaaaaggtcaactttgagccagacagcgcctttcgcggcgagaaaaaaccgaagccgaaagcagcgaagaaagacgcgagaaaagcgaaaaagccatcggcgaaaacgcagaaaatagccgcagcgaccaaagcgaagcgtgcggcgaagaaaaaagtggcagagtgatcattaccctcttcaaacagaagagggtgaattatccgtaggccgggcaagcgtggcgctcccggcaaaacgtaaacaacgagtacattaatgagcgaaatgatttacggcatccatgcagtgcaggccctgctggagcgcgcccctgaacgttttcaggaagtctttattttaaaaggccgtgaagataaacgtctgttaccgctgattcacgcccttgagtctcagggcgtggttatccagttggcaaaccgccaatatctcgatgagaaaagcgacggtgccgtgcatcagggcattatcgctcgtgtgaagccaggacggcagtatcaggaaaacgatctgccggatctgatcgcttcgctcgatcaaccgttcctgctgatcctcgatggcgtaaccgatccgcacaacctcggcgcgtgtctgcgtagcgcggacgccgctggtgttcatgcggtgattgtgccgaaagatcgctccgcacagctcaacgccacggcgaaaaaagtggcctgtggtgcggcagaaagcgttccgctgattcgggtgactaatctggcgcgcaccatgcgtatgttgcaggaagagaatatctggatcgtcggtacggcaggcgaggcggatcatacactctatcagagcaaaatgaccggacgcctggcgctggtgatgggcgcggaaggtgaaggtatgcgtcgcctgacccgtgaacattgcgatgagttgatcagcatcccaatggcaggaagtgtttcttccctgaacgtttcggttgcaaccggaatttgcttatttgaagcggttcgtcagcgcagctagttcctctgaattatgaaaagccatccagatttggatggtttttttttgtctatagctggtaagataattacgtactgcaaatattaattttattaatatttaaacttaatctatatggaataatatatgacatggaatccgttggcgctggcgacggcgctgcaaactgtacctgaacaaaatattgatgtaacaaatagcgaaagcgcattaattattaaaatgaatgattatggcgatttgcaaatcaatattctttttacttcccgccaaatgatcatcgaaacctttatttgtccggtaagtagtatcagcaatccagatgaatttaataccttcttattaagaaatcagaagttgatgccattgtcatcggtagggatctccagcgtgcaacaggaagagtattacattgttttcggtgcgttatcgcttaaatcttctcttgaagatatcctgcttgagataacctcgctggtagataacgcattggatctggctgaaattacagaagaatattcacactaattacaaggacgggtatttatgggaattttaaaaagtttatttacgctggggaaatcgtttatctcccaggcggaagagtccattgaagaaacccagggcgtgcgcatgctggaacagcatattcgtgacgctaaagctgaactcgataaagccggaaaatctcgcgttgatctgctggcgcgagtgaaattaagtcacgataagctgaaagatttacgtgagcgcaaagccagtctggaagctcgtgcgctggaagcgttaagcaagaacgtgaatccgtcgttgattaacgaagttgctgaagaaatcgcgcgccttgagaatctcattaccgctgaagagcaagtgttgtcgaatctggaagtctctcgtgatggcgtggaaaaagcagttacagcgacagcgcagcgtatcgctcagtttgagcagcaaatggaagtcgttaaagccactgaagccatgcagcgtgcacaacaggctgtaacgacctctactgttggcgcatcttccagcgtttcgacagcggcagaatccttaaaacgcctgcaaacgcgtcaggccgaacgtcaggctcgcctggatgctgccacacagttggaaaaagtcgcagacggtcgcgatctcgatgaaaagctggcggaagccggaattggcggtagcaataaaagtagcgcccaggatgtattagcaagactgcaacgccaacagggcgagtaattttttgccagcctcactgcaaggctggcaactattttaaggataaaatatgtctggttttttccagcgtctgtttggcaaggataataagcctgctatcgctcgcggtccgttgggtctgcatctcaatagtggttttacgctcgatacgttagcgtttcgtttgctggaagatgcattgctgatcgagctaccgggtgaagaatataccgtggccgccgtcagttgcatcgatctgggcgggggtagccagattttccgttactacacttcgggcgatgagttcctgcaaatcaataccactggcggcgaagatattgatgacattgatgatatcaagctctttgtctatgaagagagctacggtatcagtaaagagagtcactggcgcgaggcgatcaacgccaaagcgatgggggcaatgaccttaaactggcaggaaaaacgctggcagcgattttttaacagcgaagaaccgggaaatatcgaacccgtctacatgctggaaaaagtagaaaatcaaaaccatgccaaatgggaagtgcataattttagcatgggctaccaacggcaggtgaccggagatacttacgaatatttgctgttaaatggtgaggaatcttttaacgatctcggcgagccggagtggttattttcgcgcgcgctgggggtcgatatcccgctgacatcacttcatattattggttaattacaaggacgtttacaatgcatatactggattcacttcttgcctttagtgcctatttttttattggcgtggcgatggtgattattttcctgtttatctactccaaaattacaccgcacaacgaatggcagttaatcaaaaacaataacaccgcggcggcactggcgttcagcggaacattgttggggtacgtgatccccttatccagtgcggcaatcaatgcggtgagtattccagactatttcgcatggggcgggattgctctggtgattcaattactcgtttttgctggcgtcaggctttatatgcccgcattaagcgaaaaaattattaatcacaataccgcagcaggaatgtttatgggaaccgccgcgctggctggcggtatttttaatgcagcttgtatgacatggtaatggacgatcatggccagaaaacgcaaatccagaaataacaaaaatatcggacatggggcaatcagtcgcattggtagaccgcataatccttttgagccgcgccgcaatcgctacgcacaaaaatacttaacgttggcgctaatgggcggtgccgcttttttcgtattgaaaggttgtggcgatagtggcgatgtcgataacgacggcgacggaacgttttacgcgactgtgcaggattgtattgatgatggtaataattcagatatctgtgctcatggctggaacaacgccaaagcggcattttatgccgatgttccgaagaatatgactcagcataattgtcagtctaagtacgaaaattgctactacgacaatgttgaacagagttggatcccggtcgtttctggatttttgttaagccgggttattcgtaaagatcgcgatgagccgttcgtctataacagcggcggatcctcatttgcttcccgccccgtctggcgcaacacttccggtgattactcctggcgctccggttctggcaaaaaagagtcttactcttcgggcggctttaccaccaaaaaagcgtcaaccgtttctcgcggcggctatggtcgttcttccagcgcccgtgggcattggggaggctaatcatgctgagacacaacgttcctgtgcggcgggatctggaccagatcgccgccgacaacggtttcgactttcatatcatcgacaatgaaatctattgggatgagagtcgggcttaccgctttactctgcgccagattgaagagcagatcgaaaaaccgactgcggaactgcatcagatgtgcctggaggtggtggatcgcgcggttaaagatgaagagatcctgacgcaactggcgatcccgccgttgtactgggatgtgatcgccgaaagctggcgcgcacgcgatccttcgttgtatggccgtatggattttgcctagtgtggtaatgcaccggttaagttgctggagtacaacgccgatacgccaacttcattgtacgagtcggcttatttccagtggttgtggctggaagatgcccggtgcagcggcattattccgcgcgatgccgatcagtacaatgccattcaggagcgcctgatttcacgctttagcgagctttacagtcgggaaccgttttatttttgctgctgtcaggataccgacgaagacaggagtaccgtgctgtacttgcaggactgcgctgagcaggcagggcaggagtctcggtttatctacattgaagagctcggtttgggcgtcggcggcgtactgaccgatcttgatgataatgtcatccagcgtgcatttaagctgtatccgctggagtggatgatgcgtgacgataacggcccgctgctgcgcaagcgtcgtgagcaatgggtggagccgttatggaaaagtatcttgagtaataaagggctaatgccgctgctttggcgcttcttccctggtcatcctaaccttcttgcatcctggttcgatggtgaaaaaccgcagattgccgctggcgaaagctatgtgcgtaaaccgatttactcgcgcgaaggcggaaacgtcaccattttcgacggtcagaataacgttgttgaccacgctgatggtgattacgccgatgaaccgatgatctaccaggcgtttcaacctctgccgcgatttggcgatagctacacactcatcggtagctggattgtcgatgatgaagcgtgcggaatggggatccgtgaagataacacgctgctcaccaaagacacatcacgtttcgttccgcattacattgctggataagaatgttttagcaatctctttctgtcatgaatccatggcagtgaccatactaatggtgactgccattgatggagggagacacagtgcactggcaaactcacaccgtttttaatcaacttataccattaaataacagcaacttatacctgtctgatggcgcgctttgcgaagcggtaacgcgtgaaggtgctagctgggatagcgattttctcgccagtattggtcagcagttaggaacggctgaatcccttgaactggggcggctggcgaatgtgaatccgcctgaattattgcgctacgatgcgcaaggacgccgtctggacgatgtgcgttttcaccccgcctggcacctgctgatgcaggcgctatgtaccaatcgggtgcacaatcttgcctgggaagaagacgctcgctccggcgcatttgtggcgcgcgcggcgcgttttatgttacatgcgcaggttgaggctgggtcgttatgtccgataacgatgacctttgccgccacgccattgttgttacagatgttacccgcgccgtttcaggactggaccacgccgctgctgagcgatcgctacgattctcacttattgccaggtgggcaaaaacgtggcttgttgatcggcatgggaatgacggaaaagcagggcggttccgatgtcatgagcaacaccacccgcgcagagcgtctggacgatggttcttatcggctggtggggcataaatggtttttctcggtgccgcaaagcgatgcgcatctggtgctggcacagaccgcgggcggtttgtcctgcttttttgtgccgcgctttttgcctgacgggcaacgcaacgcgattcgcctcgagcggctgaaagataagctgggtaatcgctctaacgccagctgcgaagtggagtttcaggatgccattggctggttgttggggcaggaaggggaaggaattcgtctgatcctgaaaatgggtgggatgacgcgttttgattgcgccctgggtagccatgccatgatgcgccgtgcattttcgctggcgatttaccatgcacatcaacgccatgtttttggtaatccattgatccaacagcctcttatgcgtcatgtcttaagtcgcatggcacttcagcttgaagggcaaacggcgttgctgtttcgtcttgcgcgagcgtgggaccggcgcgccgatgccaaagaagctctgtgggcgcgtttatttacgcctgcggcgaaatttgtgatctgcaaacgtggcattccgtttgtggccgaagcgatggaggtgctgggcggcattggttattgcgaggagagcgagctgccgcggctttaccgggagatgccggtaaacagtatttgggaaggttccggcaatattatgtgcctagatgtgctgcgcgttctcaataagcaagcgggcgtatacgacttattgtcggaagcatttgtggaagtgaaagggcaggatcgctattttgatcgcgcggttcgtcgtttacagcagcagctgcgtaagccagctgaagaattggggcgagagattactcatcagctattcctgctgggctgcggtgcgcaaatgttgaaatatgcctctccgccaatggcgcaggcgtggtgtaaggtgatgttagatacgcgcggcggcgtacggttgtcagagcagatccagaatgatttattgctgcgggcgacgggaggagtgtgtttgtaagcgtatacgactgatgcgacgctggtttcgattaactaaatgaaatattttaaaattgtaggccggacaaggcgctcgcgccgcatccggcattgttcatttgctgtagatgacactcacgcatacagtatcgcctgtacgcgccagttatcaggctgctggtcttcgtacatggtaataatgcggtaccatgacgcaccttgttcatcggcctttaacgccacgatacgttccacgtcctgcggatcccctgaaatattgctaactgagatctgacctatttcattcaggcccgtcacgcagtcagcactggcgaattctgcagactgtgccgtggcgctcgcaggataagtaactaattgcagcgagggtgaggcaagtaattgtttcatcgtcagctccatttttcgtttccccacatgttgcagggcattccatcgcggtaataaacgcccgagcttccagccggtaatttattgtgcacaggtaaacgcatagggacgcaaagcaatgtaaagctgactatgtaagttgtctgatttatttacggtacaaaatggcttgtgaataccactgtcctgtcacgatggtttcgtccaccatgacgacaacgtaataatcagcttttgcagcgacagctttcgctctgatttctgctaatgcgtcatccggagaaccccgaaccatcgtgcttacgctacctattcgctgtaacccttgcgtctggtcgcggcgaatctcttgcggatggtccgttactggcggtgctggctgtggcgtaccttgcagtgcgctacaggcacttaacatcaacaccaataataaactggcaaaccggtaaataacgctattacgtttcctgctaaccatagtgtagtgccttattaatttaactttgggggaatgttcccgaattgttacctggtacgcgattttcgaatgaaaacgtgacgaaagcgtaacccacatctcaacattatgaactaataccgccagcagaaacttgtgctaaggatttcttcatgtcataccagacaaaaaggagagacagatgattgaaatagaatcacgcgagctggcagatattcccgttcttcatgcttatcctgtcgggcaaaaagataccccgttaccgtgtgtgattttttatcacggctttacttcgtccagtctggtgtatagctattttgccgttgcgctggcgcaggctggtttgcgggtgatcatgccggatgcgcccgatcacggtagccgttttagtggcgacgcagcgcggcggttaaatcaattctggcaaatcttgctacaaagtatgcaggaattcactaccttacgtgcggcaatagccgaagaaaactggctgcttgatgaccgtctggcagtcggtggcgcgtcgatgggcgcgatgacggcactgggaattaccgctcgccaccccacgataaaatgtatcgccagcatgatgggatcgggctattttacatcgctcgcccgttcactgtttcaaccgctgatacctgaaacggcagcacagcagaatgaattcaataacattgtcgcgccgctggcagagtgggaagcgacaaaccacctggaacagcttggtgacagacctctactgctgtggcatggccttgacgatgacgtcgtgcctgccgacgaatcactacgtttgcagcaggccttaagcgagacgggacgggataaactgctaacctgttcatggcagccaggtgtgcgtcaccgcattacgcctgaggcgttagatgctgccgtgacatttttccgccagcatctttaaacacgcagaatgctgaccccttgcgcttccagttgttgcaggatttccgggttagcatttttgccagtgatcagcatatcgatttgatcggcacggctaaaaagcattcccgcgcgttcgccaatcttactgctatcaaccagtaccaccagtttccctaccacgctcagcatcttctgctctgccattgccgtcagcatatcggttttatacaacccttctgctgtcagtcctttgccgctggtaaacatccagtgcccggcatagagactgttttcgctgccttgcgggcttaaagtgatggactgacttttgttgtactgtccgcccataatgatcacgctgtcatgctcctgatcgatcaggtaatttgccagcggtagataattagtgatgatttgcactggcttgccacacatttcccgcccaagcagaaacgcggtggagccgcagttgatgactacgctttcgcccggattaaccagctgcgaggccgctttagcaatacgtactttttcatcgtgattctgcgcttgatgcagattcatcggcgtccagcgcgggcgctgttgggtaatagcttctgcgccattgcgcacttttttcagtttgccgctttcgtcaagtttattgatatcgcgtcgtgcagtggcaggcgaaattcccagacgctcaacgactttctcaacggtcacaaagcccaattgtgcgagcatttccaggaggatttgatgtctttgtgcttcagtcatgagctattccgataaaatttgatttttttagatgatatttgaaatagccaggaaatactatgccggatagcgcgagcatctccacgctatccggtacaagcgacagattacaggaacgacttgaacggcagatctggttcaatagtgaagcaatcatcgaaaccacgcggatagtggtactcgaagttgtctttatccagcggccaggtaaatttgccgccgacctgccagataaacggcttgaagccatacttcaggcgatcttttttcatctcccacagcacgcggatctcttgcggatcggcctggaagtttgaccagatatcgtggtggaacgggatcactactttcgcattcagcgcttcgcccatacgcaagatatcagcactggtcattttgtcggtaataccgcgtgggttttcgccgtatgaacctaaagccacgtcgatctgatgctcattaccatgttttgcatagtagttagagtagtgggagtcgccgctgtgatacagggtaccgcctggggttttgaacagatagttcaccgcgcgatcgtccatgccgtccggcagtacgccagccgctttttgatcggcaggcagggtgatcagtgccgtacggtcgaaagcatcaagtgcatgaatttcaatgtcttttaccttcactacgtcgcccggtttaacgacgatgcaacgctctttcggtacgccccagccaatccacaaatcaacgcaagttttcggtccaatgaacggtacgtcatcagcacagttctgcatcacggcagcagcgacgttaacgtcgatatgatcgttgtgatcgtgagtcgccagtaccgcgtcgatctggcgaatcgcaaacggatcaagaacaaacggggtggtgcgcaggtttggctgcagttttttcacgccagccatgcgctgcatctggtgaccctgtttcattaacgggttaccgtggctttgtttgccagtaccgcaccaaaaatcaacacaaacgttggcaccgccttctgatttcaaccagatcccggtacagccgagccaccacattgcgaaagtgccaggtgcgacctgctcttgctcaatttcttcattcagccagctaccccactccgggaaagtgctcaggatccaggactcacgggtgatacttttcactttactcatcgccatttaccttcgtgatagttcaattcgaatcaatatgtgattggttttgattaatcctgacactattttttcaggaaggaaatgacaattttttgactttttagcaggagagttattgtggattttgagtgtggaaagattaaattgaatgtgtaatgcaattaactaaatgaatttaaatgaataaatatttcattatgtgaatcccattctgtttatatggaattatttgcgtgcgacgtcacatttaatcataaataatcttattgtgattacttttgaaaattagagtgagagcacaacattccgggtgtacgaaatacccggttacctcttcttcaggagatcgttatggagatcctctacaacatctttaccgtgttttttaaccaggtcatgaccaatgccccgttgttgctgggtattgtgacctgtctgggttacatcctactgcgcaaaagtgtcagcgttattattaaaggtacgattaaaaccataattggtttcatgttgttgcaggcagggtccggcatcctgaccagcaccttcaaaccggtggtggcgaaaatgtccgaagtctacggcattaacggcgcaatttccgatacttacgcgtcgatgatggcaaccattgaacgcatgggcgatgcctatagctgggtgggttacgcggtgttgttagcgctggcgctgaacatctgttacgtgctgctgcgccgaattaccggtattcgcaccatcatgctgactggtcacatcatgttccagcaggcggggctgattgccgttacgctgtttatcttcggctactccatgtggacgaccattatctgcaccgcgattctggtttcgctctactggggcattacctccaacatgatgtacaagccgacacaggaagtcaccgacggctgtggtttctccattggtcaccagcaacagtttgcatcatggattgcctataaagttgcgccgttcctcggcaaaaaagaggaaagcgttgaagacctcaaactgccaggctggctgaatattttccacgacaacatcgtctccacagcgattgtcatgactatcttctttggtgccattctgctctcctttggtatcgacaccgtgcaggcgatggcaggcaaagtgaactggacggtgtacatcctgcaaaccggtttctcctttgcggtggcgattttcatcatcactcagggcgtgcgcatgtttgtggcggagctctctgaagcattcaacggtatctcccagcgcctgatcccgggtgcggttctggcgattgactgtgcggctatttatagcttcgcgccgaacgccgtggtctggggttttatgtggggcaccatcgggcaactgattgcggttggcatcctggtcgcctgtggctcttcaatcctgattattccaggctttatcccgatgttcttctccaacgccactatcggcgtgttcgctaaccacttcggcggctggcgcgcggcgctgaagatttgcctggtgatggggatgatcgaaatctttggttgcgtctgggcggtgaaactcaccggaatgagcgcctggatgggcatggcggactggtcgattctggcaccgccgatgatgcagggcttcttctccatcggtatcgcctttatggccgtcatcattgtcattgcactggcttatatgttcttcgctggccgcgcactgcgtgcagaagaagatgcagaaaaacaactggcagaacaatctgcttaataaggagttttgattatgaccgtacgtattctggctgtgtgtggtaacggacaaggcagttccatgatcatgaaaatgaaagtggaccagtttttaacccagtcgaacatcgaccacacggtaaacagctgcgcggttggcgaatacaaaagcgagttgagcggtgcggatatcatcatcgcttctacccatattgcgggcgaaatcaccgtgaccggcaacaaatatgtggttggcgtgcgcaacatgctctctcctgctgattttggcccgaaactgctggaagtgatcaaagagcatttcccgcaggacgtgaagtaaggacgcgccatgaaattacgtgattcgctggctgaaaataaatctatccgcctgcaagcggaagcagagacatggcaggacgcagtgaaaatcggcgttgatctgctggtagcggcagatgtggtagagccgcgttactaccaggcgattctggatgcggttgaacagcacggcccgtactttgtgctcgcacccggcctggcaatgccgcacggacgcccggaagagggggttaagaaaactggttttgcgctggtgacgctgaaaaagccgctggagttcaaccacgaagataacgatccggtggatatcctcatcaccatggcggcggttgatgccaacactcaccaggaagtgggcatcatgcagatcgtcaacctgtttgaagatgaagagaatttcgaccgtttacgtgcctgccgtaccgagcaggaagtactggatctcattgaccgcaccaacgcggcagcttaagaaggaattgaacatgtcattaccgatgttacaagtcgcgctggacaaccagactatggatagcgcctacgaaaccactcgcctgattgccgaagaagtcgacattatcgaagtgggcaccattctttgcgtaggcgaaggcgtgcgtgcggttcgtgacctgaaagcgctgtacccgcacaaaatcgtactggctgacgccaaaattgccgatgcaggcaaaatcctttctcgcatgtgcttcgaagccaacgctgactgggtgaccgtaatttgctgtgcggatatcaacaccgccaaaggcgcgctggacgtggcaaaagagtttaatggcgacgtgcagatcgaactgaccggctactggacctgggaacaggcgcagcagtggcgcgacgcaggcattgggcaggtggtttatcaccgcagccgtgacgcgcaggccgcaggcgtggcatggggcgaagcggatatcaccgcgatcaaacgtctttccgatatgggcttcaaagttaccgtcactggtggtctggcgctggaagatctgccgttgtttaaaggcattccgattcatgtgtttatcgctggtcgcagcattcgtgatgccgcttctccggtggaggccgcacgtcagttcaaacgttccatcgctgaactgtggggctaaggagcggatatgttgtccaaacaaatcccgcttggcatctacgaaaaagcactccccgccggggatgaacttaatcaatctatattattgaataataagtatatatttaaacacatccctataaatagcccccaatatagcccccaaggtgtagttgttatacatggaggtatattgaactctgttgaaatattctctgtaatggttcagtgaatgcagcatacctacctgtcttgttccggacgagacacaatacctgtgatatataagtctatactgaagaagatacttttcccgcataatgtttcgcaataatatcatttagccgatcaaccagttctggtttcctgaacgtgatgtgtgcggagcccttcttaaagtatctgatgttgaacatctcatcttcatagcacactttgccctgaacggagcggatgtgatcatccagccgaatgatgatattttcccggctgtcggggatcggtttgccgctgaacaggtatagcattctttccaggtcggcgagtcgatctgcctgttgcccggtgataagatgcaatccccatctgtcccacctcaccaggttgttgacgataattttactgccaaatttacagggggaattggttttgtaattccagctcagccctctgaagacgttgatcactcctcgctcaaacacttcatccttattctggtgcagttgctcaaatgtgctccaaatgttcgcttcactgatttccggaaagttatcgtactccagtgagtggtaccatgtatcacgggcctgcgcatccattaatgacagcatcccggaacgttgcatcaggtcacgccagatttcgcggtcaaggttgcgggtgatggctttcattgcggtttccggtttctccatgagccagcagccacagcgaaaatcctgtttcatggcccagtccagagcagttttacctccaatactttctgtcagtaccgagatttcagccagttgccggataagtgtgtcgatttgcagcagtgtagtctttcgcacagccagaatgtgactgactgaggtggagcagataacgtccgtatgcccggtgaccacttccggacgggagactgtgattgcagacataatcgatattccttttcgcagataaatgaaaacgccagccctgttcaggctgacgtcagtggaatgaagtctggtgagtgagattcaccggttctggtgcagaagctgcagttggcgcagggtacggataccctccctggcctgttcgatacaaggcaacagtgctgccgaatcagttttatcctcatcgttgtcgaagataattcccgattcgcagtcgatattgtcctgcagccacgtaatcagaatatccagcgctgtttccgtggttaatgatttcatgttgttcctggtgaccagtcgaaagtgggcaggcccggcagatattcagcgctggcatccagatgaatgagactgacgccataacgtcgggtaagtgtgacaaccagacgacggaacgtttttgacagccccaggcgtttaagccgcagaaccgggtatgaccacgcatcggtacgtaacagatatccgcagcctgtaaaatgaatccattctgattcgccggtgtcattcgtctgatgcgacatcgagtacagccaggcgctgtcttttgccgtgatatgcgcggtactgcagcgtatgccggtcagggcagcaaatggtggcgtgcagtctgttgaggcccggtcagattcatcaacaacacgaagggagtgaccgttatcgcagaccacgttaatcagttcagcaagctcaataccatcgacgtcaacgacaatgcgccccatgttcagtgcctgcacgttaatgctgtcggcttccagcgtcagggccagtttcattgtttcgcccccggatgtttacccagggtaatgttatttaccgttctgtaattgtcgcggaccatcaggccggccgcccgacgggcccggaggatatcaatactgtttattaactgagaacgggtacaagcgctgaatcctggctggtcggtacgtaccagtgcgtatttttcaacgagaaagttcaccgcatcgcacagtgaaatgcctgcctcaatatgctgctcaatcacacgttcatcagcgaacggtgtgtcattcagtgtgaggccgtaatgctggtccaacagtcgggtgagcagtgtctgccagatggtgacgggagacgggcagcgcgatgcctcccgtacgtgtgtgtcaggtaatgttttcatcttaagttctctgtaactggtagtgctaaaggtgagatattcggggttatgaggtggttgcgggtgccagtgtcggataaacagccatataaacgtaaccacagctgccgagggtgtcggcttcgcaggtcagccctctggcatacagcgtgacggtatgctgatggcggggattcagttcaccgctggtgagcatgagttccagttgtttcatcagcagtggaaaaacctggtccagatggtatgcatccgcgtcgctgaactgccctctgataccggcgcggtcggcaaggtaatgcaactgattgccctcctgcaccagacgtgccccgaaacagggcgtcacggtgcagggtagcccccaccaggggcggtcgttgttgtcgtcgggataatttgtttcatggagcgtgtctgacacgataaagtcctcacagaaaatcggttaagaatggtccggtagtggcgataattctgctcatcagaattcccttccagactcagttcagggtgacgctcatcagccggacatacggaccaaaactgtccttacggcgttctgcaaacacagccagtacaccgggaatatcctgcacttcacggccggtatatgtatccgtgctaccgtgccagcggtatttaccggtacagaacggaaaaagacgggatgcaggatgctgacggtgaatacgcatggcttcaccacgggtgatgattttcatgagaatagtcctcctgaatgtgaaagtaagaaacagctgagaaagagaaactgaagtgatatgaaggtgattgtgacggtgacgggttaaagcagaccgtgttcggcaaaggagaaaacctggctgccaccgactatcagatggtccggcacccggatatccaccaggcccagtgcctgtaccagacgttccgtgataaggcggtctgccttgctgggtgtgacttcaccggacgggtgattgtgcgccagcaccacggcagcggcattgtggtacagggcgcgtttaatcacttcccggggatggacttccgtgcggttgatggtgccggtgaagagggtttcaccggcaatcagttgattctggttattcagatacagcacccggaattcttcacgctccagtcccgccatgttcagaatcagccattcccgtgccgcacgggtggaggtgaaggccacaccgggttcatgaagatggcggtccagggttttcagagcccgcagaatgagactgcgctcgccgggcgtcatttctccgggcagaaaggaaagctgctgcattgtccctgcctccattcagtcgatgatgcgcataatggcgctgcattccggatgctgcagggcgtaatcccgcagccggtaataatggaccgtcatggcataacactccgtacgacaggcgtgatgactgtacgtcatcagacaggcagcaatgccagcggcttccgggctcatttcagcgcggttgccgttcatggcattgaacagtacccatgtttcgtcatcatcgtcatccggttcggggccataaatgccccgccgttgttcagggtgtacagattccagataccaccgcagtagtcttcgcacagacggtccatccagccgaaaacacggggctccagggccacccactgtggaatgaggccaaaatgctgcggccagaagctgatgcgctgttcatcagggactatggtggcaaccaactgaggctggtcattccctgatgcagcggttacggaaacagaagatgtggtggaattatgtgaaatggttttcatgaaatgactccttaaaggacaaataaatgcgtggttttcagggtaatggctgaatcagcgcaggctctccagcagggtttccgccatcacccacaatgcgcggttgagcttaatgtcagtgtcaatgctgtgaatggcacgggtatggatacgttttcctttagcgctgcgacctgaaattccgcctttcagcatattctcctgaatggtctgataagcactccacaggtccttaccgtaatcctcccggcgtcgtggcgtcagaatgtcggcggtggtgacgggctgatgttcgtcaccataacggtaagtcagtgccgcctgtgccagcgcctggcgtgccggtggcggcagaatcagcgactgcatggcatcacgcttttcctcaatccggtcaaacacgcccaccacctcgtaagccccttcaatgactctgtccaccacatttccccggtgcggaacacgcacttcccccagagactgaccacagacgcatccgttctggcagacgaacctgaagtaacccggcagcatctggtagctggaggtaccgtcatgagagttgagcagaataatttcagggacatgttctccgtttatctctccggcccgccgcagacgcagcatgtgttttgtgtatccccggcggcccgggtcgcgcacacgggtctggcaggcgaaaaagggctgaaaaccttcccgctgcaggctttccagtacggtgatagtggggatgtacgtatagttctggcttcgggacgtgtgtttatcttccccgaaaatccccggcacatggtgcatcagctcttcatgtgtcagtgggcggtcacgacgtatctggtttgcagcataaccaaaacgactggctaatcgcatactttgctccttatcggtggttaagatttactggtgtaataaatgaaaaaagccgcgtctcccggagaagacgcggcctgatggatgaaatcaatgaggtttattgtctgagaagccctccactggcgagccacgcattaagctgttttccggcatcagcttcagagttccggctgcgtcagcgtcgctgaccttccgcgttgcggataacccgacgaaaatgcattcccgggtcatcctggataaacacattgcggtaagcggttatgacagcaaccgcctgcccgtatgagaaagatccttcagccaggacatactctgtgtaacccggcatatctgttttctcctgataaataaaaagcctctgccacgcgttgtgacagaggctgaagcatgaaactgacttcagggatcagttaacgttttttccggaaacggtaatcagcagtggatggtagtcctggggatcgaaaaccgataacggcagactgacacgatggccgttactttcttcagttgctttaatgatttcggttgtggcgacattttccacgcactccgtttccagaaatgcgtctgtggttcgcgtggcattactgtcaccaaaagcttccgtttccatttttctggtcaccagcgtctgaccatatttgtctttgagttgcagagtgatggtgagggggccaaatccttcatcgtttccgccattatccagccggaactggtaggcacaaatatttcccgggagccatatcgtatctgtattgcgtatactgatgtaacgttgatcctgtgcccggagtggggcagaccacgttaaccccagaatgaaggcggtaatcatgcaggttttgaacaggtgaatcatggtatttacctctctgagtcatgacgatgacactgacaaatcaggtgataaaacgtaaaaggcgcagaatagccgttatgccggtaactccggggggaatgcttcttccagtcggttaaccatattgccgagatgggatgcatcatattccatgacggggcgttgcctgatgatactgaccaccagtggtttgattaacatattggtcgcggcccgttgttgtataccggcggcgaaaatgatctccagagcattctgatcgataacacgggccagattctcgttcagattttcaatctcatgtccggtcagcaggaaactgccggcaagccatgtcacctgctcctgaatcattgtcagaattttgacgcgatcttcttcaaccagcgctccggcaatttttcctgatacagcggaggcaatcattccccccagaacaccgccaaccacacgccctgtcagtgcaccaaatggtcccagtggactgaacagtattccgcccgccactgacccgacagcaccacctgccacaccggaagatgccacggcaagattcctgatgaactgcgcaccggagatccgtccccgcaacattttgatcatgtcagggccggttgtgacagctaccagtgccagagatgtcaccagcgtacccttcattactttgttcagggcactgatatttcctgcaccggtccccttctgaagagccagtcggacagtcgggctggcagtcgaaaaatcaatgtgcttcagcataccctgaacaacactgagccggtggagttgctgggttgtgacgtagacagccagtgtgcgggtgaaggtttttcctgcctggacagcagctgtctgcagggcagcatcgcgatcgccggtgctgagccagaagaccgatgccgtcagggcaaaactgatccctccggccgccagactgataaccgacccctcggcaatatcataagtgaccgattcgatggtcccgaaccgggtgatattacgggcctgggtataagtcagatgtccccgacgaatcagccgggacgcttctgcgggatcggttacaccgggtactttaccttcgcggatcttattcttcatggtttccacagcgccggcatactgatcacgggggacttccagttgcatgggaccatgatttcccatgtaacgatactgtccgttttgtccgtcgaatgccgcaccgacgctacgggctgcagttgaacaatatttcgtctggatttctgttccgctgaccagtctgtctgccacttcatagacaagaatgggtaacttagacgcccatctgacacagacggacatctaagtatggaattacaggactggcaaaaagaacctcgtaaaaagtattcgaatgaattgtaagcgccccatcagcgacgtcttgtgaaaattgtcctgtctggcaacaatcgcgcccatctatattgatggacacgaacgattaattcccagacaacaaaagatattccctgcttccgttcttatttgcctgatgcactgcgtttaagatttgaagataaactgaccatccgggccatcgctcagcgtctgggtctcagtcattccacaatacatacgcttttttagcgatttcttgcatccggtatcgcatggccattgcccgattcagtttcattcgctcaacttgacgccatcctttatgccaacagaaagaaggaattaacagagcctcaaatcagagaaggctcatggcgaaaagaacggcgaaccagctatagccgtgaatttaaggtccgtctggcggcaagaaaaaccagagccgcgccactgatgcagtcactgtatgactggatacagactcagatgaaaacactgtcgcgtcactcagatacggcaaaagcgttctcctatgatgaactctctcattaatgcggcatatcggatcggcaataatctcccagccactgtaccgccgcttgtaaagtgctgctgagccaatatcactttctgataggcttctgaagcgtcatggacgttcttacgcaataacccgttataccactgtgaccacaaccagacggtaccgccgaagcaattaaacaaccaataatggtgttgataagacacggaaggatgtactgctcgccattcagccataacagttgcagggtatatacagcagtaatggtaaaaccaaccttcaccagccgtagtttttgcacaatatcaggcaactggcgaaggtggtaatcagcatcaacagggtataaccttcggaaattttaaagtgcagcgcaatcacccgcggtttgtcgtagctcagcgtggcgaataattcgtccagcgcctcaatagtccccctcaccttgcagggtctggaaaatctagttaatcgggtactgcataacactctcaatatggggataagcgataattatcgcttatccccaccaaagtatcataccccatcggtgctttacgaggcgatcgccgcgataaagcgtgtcgttatctgctgcggacgagtgattgcccccccaaccaccacggtatgagcgcctaatgtcaggcaacgtgcggcacgttccggggtatcgacgttcccttccgccacaaccggaacgctgaccgcggccaggacctcacgtaagaatccacagtcattttccgccagcacatgcctggcagtttctgcggtatagccgtagagcgtagtgcccacacagtcaaaacccagacgttcagctgtcaccgcctcttctactgttgctatatctgccatcagaagtacggacgggtagcgagcgcggatctgcgtgaccagttcttccagcgtctgaccaccagggcgcgggcgcgcagtagcatccagggcaataatttccggctcaacggtcatcaattcatccacttcccggagagtggccgtgataaacacctcactgccagggtaatcgcgtttgataatccctatcatcggaagggagacaatctctttgatagaactaatatccgccacgctgttggcacggatacctgcagcaccaccttgtgctgccgccagcgccatacgtgacataataaacggactatgtagaggctcattttccagagcctgacaggagacgattaatttacctttcagggaatccagtacagttttcattacgataaaatctcttcgacttcgtttttaatgatggtgacatgagggccataaatcacctgaacgccgttgccgcgaataatcacgccacgcgctccggtcactttcagcgcagcttcatctaccttactgctctctttaaccgtcacgcgcaggcgcgtggcgcaacagtccacctcttccagattctctttgcctcccagcccggcaatgactgccgctgcgcgttcactctgaggctggccggattcaaccagggttacgttctcacgacccggcgtcagccagccaaagcggttaatcaaatagcggaaagtgaagtagtaaaggaagaaccacggtattcccactatggggacatacatccagtttgttttagattccccctgcaacacgccgaagagaaggaaatcgataagcccgcccgaaaaggtttgcccaatagtgatatgtaaaatatgggcgaccataaacgccagaccatcgaagaaggcgtgaattacgtataatacgggcgcgacaaacaggaaggagaactcaacaggctcagtgattcccgtcaggaaagaggtcaaggctgccgacaaaagtagtccggcgacaacctttctattctccggctttgcggtatggtacattgccagacatgcgccaagcaggccaaacatcatggtgataaagcgcccggacataaagcgagcggtacccgcgtagaactgctgcgtattcggatcggcaagttgggcaaagaaaatccgctgcgtaccttcaaccaactggccgttgacgatttcactgccgcccagcgccgtcgtccagaacggcaaataaaagatatggtgtaaacccagtggaccaagcatacgcaggatgaagccgtacaacagcgtccccagatagcccgttgcatccaccaggccgcccagtccaaaaatgagtttctggaaatgcggccacaccaccgtcataaccgcacccactactatcgcggcaagggagctgataatgggtacaaaacgagaaccactaaaaaaaccgagaaactgaggtagtgagactttattgaaacggctatgtaacgtgcaggtgacgagaccaatcaccaccccaccaaacacaccagtttccagtgtctgaataccaagtgtcatcccctggccaactgaaccggggttcttgtgcgccaacgttccatttagcgttaataaggcgttgatggtagcattcatcaccagaaacgctagcaatgccgcaagcccggcagtgcctttatccgatttcgccagccctacggcgacgccgaccgcaaagagtaccgacaggttggcaaacacaatagaacctgcgctggtcatgattgtgaagattgcctgcagccagtcgacattcaagaatgggtaggccgtcagcgtattgggattcgacagagccccaccaatccccaacaacaaccccgctgcgggcaataccgcaatcggcagcatgaacgatttgccgaaccgctgcgctttttcaaaccatccccccgatgaagcgcagctaaacatttgcatcattttatcatctcctcgattattaatgaaaattttcaccgtaatcattcttataaatgaaaataaccatcaaaatacaagaagtcgatcatactttttttaaaatgtctggcatcaatcccctcctttccgccacactatcaacagataaacgcattaaggattttacatgtcagaaaatgaaaacctgctgctgagactgcgccagagcgttgatggatatagtcgaacgcaacagaaactgggagagtttgtacttagcgatccggcaaaagtagtctacctgacgattaccgaactggcgcgtgaaagcggtaccagcgaggctagcgtcacacgtctgtgccgaacgctggggtgtaagggctataacgaattcaaaatggcgcttgcactcgatctccgacaagtacagtctgtagagcacggcggtgatgagattgacaatgtggtcaatgaatcagtgcaagcactacaggacacagcaaaattactcgacaggaccttgctggaagcagccacgcttgcactgcatcaggctcagtcagtgcagatttatggcgtagcagccagtgctattctgggggagtatttacattacaaactcctgcgtctggggaaacccgcacaattgttcagcgatatgcatcgtgctgccatgaacgccacaacacttagtaaaaacacgttcgtggtggcgatttccagttctggatccacgcgcgatctgctgcatgtcgtaaaactagcgcgtaagcaaggtgtgcgtgtactggcgctgagtaatacgccgcgcagtccgttagcttcgctgagtgatattcaactggtcgcggccaaaccggaaggccccttgagcgccggcgcgctgaatgccaaggtgggagttatgctgttggtagagttactcaccacatcgctgattgcgctggatcataagtacagcgatgtgagccagcaaactgccagcgcgaccctaccgctactgctttaaagatataaaaaaccgcaaaagcactgagggatccccatgaatcagcgctaataaaccaacaccatattatggtcggttctggcgaagtgattaagaacggtgatcagcaccattcgttttaaaattagcgaggagtatcataagatattcttcgctaatgtcagacatctgctttacgggtaatgctgccaacttactgatttagtgtatgatggtgattttaaggtgcttgcgtggcttccatttccatcagatgtccttcctgctccgctactgaaggcgtggtgcgtaacggcaaaagcactgccggacatcagcgctatctctgctctcattgccgtaaaacatggcaactacagttcacttacaccgcctctcagcccggtacgcaccagaaaatcattgatatggccatgaatggcgtcggatgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacagtggggctacgtcggtgctaaatcacgtcagcgctggctgttttacgcgtatgacaggatacggaggacggttgtggcgcacgtcttcggtgaacgcactctggccacactggagcgtcttctgagcctgctttcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggccgggacggaagtcactgtcgttctcaaaatcggtggagctgcatgacaaggtcatcgggcattatctgaacataaaacactatcagtaagttggggtcattaccgatcggctgtaccaaaaaagtcttcgacattcagtcttcatttatcggacgttacaatactgctttctccgcattagtggatacgctggataacatggaggaagccgaaaagctgactatcgagccaaccgttaaaaaccagccattaccactggctgtgtcttatgttggtgaaaacacctgaaggtgcacagaaacaactggcgaagtatatccagcaagttggcgaccaggtaaataaagaactggaaaaagacctgaaagacgacatcgcgctgcgtatgaaaaacttgaatgattctctgaagacccaggaagtggtggcacaagagcaaaaaacgctgcgtatccgtcagattcaggaagcgttgcagtatgcgaatcaggcgcaggtctcaaaacctcaaattcagcaggctcaagatgtgatgcaagatactctgttcttgctggggagcgaagcgctggagtcaatgattaagcacgaagcgacccgtccgcttgaatgtaagcgtcgtctcagcaccgtctggcagatcctgaaattcctgaaagaatagtggacaccaaatatggtggacgctatccatgaaatcattaaccgcagtgcgtaaaaaaagccctaattatcccgttgagttcaaaatcaaaatggttgaactctcgcatcgaccagagatctccgtagcgcaactcgctcgtgagcatgggatcaacgataatttgctgttcaagtggcgccagtactggcgcgaaggaaaactacgtcctccttcaacaacagaaaacaacgtgcctgagctgctcccgataacacttgatgccgaagatgttgtccctacaacctccccccggtcacaacctgtagctgctgcgacacctgaatcactcaatatcagctgtgaagtgacgttccggcacggatcactccgtctgaatggtgccatcagcgaaaatatcctgaacctgctgatacgggagctcaaacgttgatcccattaccatcagggacaaagatctggctggtcgctggcatcaccgatatgagaaacggcttcaacggcctggcggcaaaggtgcagacgacgctgaaagacgatccgatgtcaggtcacgtttttatcttccgtgggcgtaatggcagtcaggtaaagctcctctggtctaccggcgatggactgtgtctgctgaccaaacggctggagcgcggccgcttcgcctggccgtcagcccgggatggcaaagtgttcctcacaccggcacagctggcgatgctgctggaaggtatcgactggcggcagcctaaaagactgcttacgtccctgactatgttgtaagcctctttatcctggtcgacgctgaatgagcctggtaatatacccggtatgagcagctcacttcctgacgatatcaatgcactgaaacgtctccttgccgaacaggaggcgctgaaccgtgccctgctggaaaagctgaacgagcgtgaacgcgaaatagaccatctgcaggcacagctggataagctgcgccggatgaacgtcggcagctgctccgaaaaagtctcccgtcgtatcgcacagatggaagctgacctgaaggcacttcagaaagaaagtgatacccttaccggtcgggttgacgacccggccgtgcagcgcccgctgcgtcaaacccgcacccgcaaaccgttccccgaatcacacccccgcgatgaaaaacggctgctgccggcagcgttatgctgcccggaatgtggaggctcactgagctatctgggtgaggatgccgccgaacagctggagttgatgcgcagcgccttccgggttatccggactgtacgtgaaaagcatgcctgtactcagtgcgatgccatcgtgcaggcccccgcgccttcacggcccatcgagcggggtatcgcaggatcggggctgctggcccgcgtgctgatctcaaagtatgcagagcacaccccgctgtaccgccagtctgaaatgtacggccgccagggcgtggagctgagtcgttcactgctgtcgggctgggtggatgcatgctgccggctactgtcaccgctggaagaagcgcttcaggactatgtgctgactgacggtaagctccatgctgatgacacgcctgtcccggtgctgttgccaggcaataagaaaacgaagaccgggcggttatggacctacgttcgtgacgaccgtaacgccgggtcaacgctggcgccggcggtgtggttcgcttacagcccggacagaaaaggcatccatccgcagacccatcttgcggggttcagtggtgtactgcaggcggatgcatacgccgggttcaacgagctgtaccgggatggccggataacggaagccgcctgttgggctcacgcccgccgtaaaatccacgatgtgcacgttcgcaccccgtcagccctgacggaggaagcgctgaaacggatcggcgaactgtacgccatcgaggcagagataaggggaatgacggcggagctgcgccttgccgaacgtcagttgaaaacgaaaccgctgctgaaatccctggaaagctggctgcgtgaaaagatgaaaaccctgtcgcgacactcagaactggcgaaagcgttcgcatacgccctgaaccagtggccggcgctgacgtactatgcagatgatggctgggctgaggcggacaataacatcgctgaaaatgcgttgcggatggtcagtctgggccgcaaaaactacctgttcttcggttcggatcatggaggagagcggggagcgctgctgtacagcctgatcgggacgtgcaaactgaacggagtggagccagaaagctacctccgctatgtccttgacgtcatagccgactggccgataaaccgggtcggcgaactgctcccctggcgcgtagcactgccgactgaataacacatccccgtcaatacggttcttgctgcacgcttacgcttgaattctcatcaaactactatcagacccgtcaaaatctgttggatattgaaggcttaaaagttgatgatcttgatattcatgcctaccgctatgttatgaaaccgacgttacctattcgtcgcgatagtccaaagaaagaaatcaccttgattctgactgtgctactgggtggtatagttggtgctgggattgtgctggggcgtaattacaacgcgaagtaatcttttcggttttggaaaggtgggcacctacgttaccaatactggcatcatggctacatacggcggtcagtttatgaaccgccccgggtttcctggagagtgttttatctgtgaactcaggctgccagatcattgtttccgatggaagcataataagctttttctgcttctgccggaggagtatggcccagccttcccagcaatcgtcgattgttataccagtccacccacgtgagtgtggccagttccacttctgcacggtttttccagctcttacggtgtattacctccgctttgtaaagaccattgatgctctccgccatcgcgttgtcatacgagtcgcctgtacttcctgttgatgccagtaatccggcttccttaagccgctgtgtgtaggccagcgatacatactgagaacctttatcactgtgatggaccgtgccggacggtcgacgggcccataacgcctgctccagtgcatccggcacgaatgtcgtttccatggacgatgagacccgccaccccacgatgtatccggcaaacacatcaatgatgaacgccacatagacgaagccccgccatgtgctgacgtaagtaaaatcagccacccacagctggtcaggtcgttctgccacgaactgacggtttacgtggtcgcctgcggcaacggctttccggctgatggtcgtacggacctttttaccccggagaacaccggcaagtcccataaccgccatgagacgtgccacagtgcatctggccactctgataccttcccgtaacaactgacgccagactttacgcacaccgtataccttgtgattttcatcgtatacgcgctgtatctctttcttcagccagttatcgcgctgcgcacgggcactgcgtttatccggatgatgtcgctgttgctgacagtggtaatacgttgacggggcaatatgcagttcgctgcatagcggtccgaccccgtactgctcacgcagcttatccagcagtggcatcactttttccagaggcggtcgaactccgccttcgcaaaataagcggaagcctggcgaaggatatcgttactgcggcgcagttcgcgattttcacgctccagctctttcagacgctgacgttcagcggtggtgagcccgccatcaccgcctccggtatcccgctcatgctggcgtacccagacacgcagagtctccggtgtacagccaatctttggggcaatggaacaaattgccgcccactgtgagtcatattcgccctgactttccagaaccatacgaatcgccctctgacggacttcgggggaaaaacgagtatttttagtcatcctgtttacctctttctcagggagtttagtctccaggattcccggggcggttcattacgcttactcaccattctttacttttttataagcgtcaataggtttgggatatgactttttcaagaagccaaactgtttggagtaagcaaaaaagcctccacaaattgctgcggaggcataaagaaacacaattatgcctaacctttagtctattgttgccttttcacaagacgattgcaatatcaccttaaggccatttttttattagcaatcgttaagcgcaatcatcaatgatcaaataggttgcatgtacaggaccatgtacgccaacaactttgatcagttctatatctgcagtagaacttgggcctccaatcagatttatacaggacggcatccgttgtccttcctgagccatatcatgaagtttttgcgcaagctgcgccactctggggagaatggtgcttttacgtaaaacaaataatgatgcttcaggcaaaaggcttactgagcgcccacgttctggtgcggagaataagacaatgcctcctgattctgtcagcccatactcagcgaaaacgacaccagtttttgccttttcagcaatatggatattttcatcgcccttctccggatcccacagagcagcgcccatttctttttgtagcaatggcgtaatccctgtatcgaccagtcgttgatcgttgctgataatgactggcccggaaccgaacttccaacagatgtctaaggcttttgatggtgcgttttcaggcgacaccagaacacactcggcaagcatcacttctgaggcaaatttaataaacgcctcacagcgttggtctgatgtcaactctgttaaacgtgttgtagccagcgtatttacaggctccggcattgcttcgggaatatgtcttactggtctgccaagctttctggcgatcgcaacgagaaattcctctctgttttccataaaattacccctccttcttatgtcgcttgaaccaactacggaagctttctccatcaggtgatggcaggtctctggcttcagtccactcttttatcgctccaacactaatcggcgtttttcctttcctgatgaacagacgggctgttttggccccagcaaccatacctaccttccacaacgccggatggctgtttatgtaattgaatgctctggttatacggcgttccgttaatggtgtgatttcagactctgccataacctggcgatgtttttgtattagcgttgccagaggtatttttacaggacataccccattgcaggcagtgcacaatgagcaggcatagggtaaatccctaaagtcttcatatcccccaagcaatggggaaataaccgcgccgattggccccgggtagattgaaccataaccatgcccaccaatctgacgataagccgggcaggtattaatgcaagccccgcagcggatacatcgtaatacatcgctgaattctgagccgagaatctctgaacgcccattgtcaacaataatgagatggaactcttccggaccatcaacatgtccttcttctctggggcctgtaagccaggtgttataacctgtcagtctcgccccgacagcactccttgcaagcatggtaatcagaacatccacctcctggaatgtcggagcaatacgctccatacccataacagcaatatgtgttttaggtaatgtggtgcacatccgtgcgttgccttcgtttgtcacaaggcaaactgaccctgtttctgcaacggcaaagttacatcccgttacgccaacttcagcactcagaaaatcttgtctgattttctcacggatgaacaatgtcattgcttctggagtttcaggcccgtcataccccagatgttcatgtaaaactctgcggatttgatggcgatccttatgtattgccggcacaaccacatgcgatggcggctcatgtgctagctgaagaatatattccccaaggtccgtttcaatcacgggtatcccggctttctgaagaacggcattcatgccaatttcctcagtcaccattgatttggatttaacaaccttcctggcgtttttttctttcgccaccttcagtatgtaactggttgcatcctctctggtacgggcaaaatatacatgcccgccattcgcggtaactttttcggacaattgatacaaataagcatcaagattttccagaacatgccgacgaatctgttcagctcgtgaacgccattcctcccagtgtcccagttcatcaaccattttctgtcgattagtccctatgcgctcctgtgcgttagccacagcttttcgcatgatcgggtcctgaatctgaatacggatacgctctttaaacctgatatcacttgttttcaaagacattctgtttacctcatctgtgcatcaggacttcagcaatatgcatcacttttacaggatgcccttcacggttaagccgaccgccgatgtttagcagacaactggcgtcagccccgataagaaaatcaggtttaacatccataatatgcccaactttctctttcaccatttcaccagagatctccgccatttttacagagaatgtgccgccaaacccgcagcacgtttcctgagcgtgaaacggcagtagctcaagcccctgtacattctcaagtagcaaaagcggctctctggttacacccagtttacgggaaaggctgcaggagggatggtacacagcgcgaccattgagttttgccccaacatctgtgatgccaagatgatttactataaatgatgtcaaatcatgcaggcgttcagccactttttcagctcgtgctgcccactcaggttcttcactgagatagcgagcgtaattttttatcgtgtaagtgcatgacccggcaggagatactaccggccagtcattctcttccagcgaagatatgagatttttcatgcctgggatggcatcacgaacataaccgccatttatcgctggctgaccacaacatccctgcttttcggggaaatggacattgcaacccaattgctccagtaacagcacactcttttgtgccatccgggatttaaacgcatcaccaatgcaggtgacgaaaaagttaacattcacagaaatttctcctgttgattaatattccacgtccttttgttgttttttctcaggccatgaacaggtggtagacaaggcctactttcagtccaagaataacaatataagcaaagcagtacttcagtgttcctgacatgattacgctgccctgaccatccatacgggtggctgaaacagcgatagcaatactctgaggagaaatcattttgccgcctgttgcgccagatgtatttgcggcagccagccagagcgggtccacatgcaatttttcagccgcagtggtctgcaatttaccgaacagaatgttggagtttgtgtcactgcctgtaacaaatgtaccaagagcgccgataaccggagcaatgaagaggtaggctccaccagtgagatccacaaggctttgtgccagagtgccaattaacccacaaacatccattaccgttgccatggcaacaatcgcagaaatggcaataatggagtttttgagctgttttaccgtactgataaatacgtttaacagacatgacagggatgctttttgtatcaagccgccaataacactggcaatgataatcagaacaccgggggttgcgatccattcaatcttcatcgacagattgctgccgttactcagagagaaactgagtgacgaggcaatctgagacaccgcactttttatcgtcgggaacagtggagagcaaagcagaatgaacagaaaaatcaggatgtagattgagcacgcacgtaacaacgccccacgagagtatgaaagtgcgctggcgctatctgctgaagtatcaataagaaattcaggttctgttttttctttacggttttttgccataaagactataacgatcagactgacaagacttcccgcgaaagccgggagttctgcaccaagattaacagccaccagatactgaggtatcaatgtgctgacaccgcacatcagggtaattaatcctacgcctcgtatagccttcatccctccaccgataatcgcgacgatgacgaaggggagcagaatgttgaacagtgccagctgaagaataatcgtcccactgagtgtggttacaggcaaattaacttgttcagcaagtacagagacaggtataccgactgctccaaatgctgtagggactgtattagcaaccagtgacgcaattgctgcttttagtgggttaaagcccagtgcaatcagtataccaatggggattgctacagctgtaccgtaaccggctgccgcctcaagaaatccgccaaaacaccatgagataagaagtacctggatacgcttgtcatcactaacgctcgccagaacatttctcagaatatccatgctttttgtcgcattcatcaggttatagctgtaaatggcagcgaggataacaatcacaattggccacaaacctttgattgtgccgtataccacagcagatcccatatccataactggcgtctgccagaaaacacccccaaggattagcgtgatcaggagagtgctaagcacggcataatgtatgggcattttgactttcagaatcaaaatgatcatcgccagaagcggtgtaagtcccagtaaaaaaagcaggtaatcgtgcatgtcatttcctcaaacgaaaacaaagtcagcatcattactgtggatattgatagtctccacaccctgtcggacgagagcgtttagttatcagggggagaatgagtatcgcctccaaaattgggatgttcttataaagtattttttagtttaaaaaatatagctgaatcgtttcattgttatcttccatgaataaatgttatgaaataatactttttgggtattttttgtttatgcgtgtaacacttgtgtgctatcccgatataaccttaagactggagttgcaactggagctcgtcgaaaatcaacgcccaaatcctcgacaaatggagaaagagaatgagcaatatcaccaggaatagtttagttgtagcaggcgttctggctgcgcttatggcagggaatgttgcgttggcatctgatgtgcctactgaagtgactctaatagaaaaacaaacgctggtacgtaacaacggtgcagaggttcagtcagagcaggacactgactgtcgtctgagaggaagtggataaagccggagcaagagagccaaatcatgatcgattcgaatgccaaactatgatcgattcagatgccattttgcaattaatttaaagtgttataaaaaaacatgataaaaatatgttatatagttgtatataaagtattattatctgaacaggttattatatattaaatggaacaggtgatgctgccaacttactgatttagtgtatgatggtgtttttgaggtgctccagtggcttctgtttctatcagcggtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaactgcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacaggctccgggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataaccggaatctgaggcagcacctggcacggctgggacggaagtcgctgtcgttctcaaaatcggtggagctgcatgacaaagtcatcgggcattatctgaacataaaacactatcaataagttagagtcattaccaatggaacagaagattattaattacttatccagtaatagccctgcaaaattaggcgttttattgaatgatttaagtataacaaaggaggtgcattactccgcaacattaattttacgagcaaaaagaagaattatacaccagagaaatgttggtgtaattctcttgtgtgataatgttatacagaatatgcaaatgtagtttacatttgtcctgtctattcttatttgtaagcgttaaccgagtgccgtattgacggttatttattggtaatatactacattccatggcgagagttcgtcaacacggttggaaggccattccagtagtacgcccaggatatggcgcaaatacgcttctggttcgatactgttcagtcggcaggtgccaatcagcccgtacagtagcgctccacgctctccactgtgatcgttgccgaagaacacgtagatgatatgacctttatatactcactatagcattggtgggatattccagaggtcatcatggattcggaaaatattgcagcttacgtcgggctggatgttcataaagaaaccttggcgattgctacacctgaatggcttggcgaagttcgttattatggtacgattaacaacgaagtcctggctgtacatcgattatgtcagaaattgcagggaccttacggaaacattctttcctgctatgaaggtgatccctgtagttttgggctatatcatcaactcacagtgatgaatataaaatgcctggttattgcccccttcccgtatacccaaatcaccggcagacaggatcaaaaatgaccatcgggacgtaatttctctcgccaggttactgagggatggtgaggttcccccagtctggctccctgagctgactcatgaagctatgcgggatttaatcagagcccatgccgctgcaaaacgtgacacgaacagacaaacgttatgccaggaagcactgaaccggcaaacatcgaacctggttagttaatcaatcatttggtctgctatctcaacagattgctttcaacattattgtcagaatctggagcagattgaagatcgcatacttcaactcgatcaggaaatatctcgcctgttacctgagtgatctctgtgcaatctggtctgccagttgcaggctcttaaaggtgttggtcagctaatcgcaataaccctggttgctgaactgggtgatttttcgcgattttccaatcctgaacggctcatggcttttctgggactggtgccaggtgaatattccagcggaaacagcattcgccccagaggaataacaaaagttggaaacagtgaactgagacatctgctttacggatatcaaataaattcagattatttaacagtaaaaccccacttatgtgatgaatctcataaaaaagcaaagtgaagtaataatatccaatttatccctcattccttaagtaagcgtacactggccgcgtacaccatggcataatgatatgttgttttactgatatttccggctgttaaaatccccgacggcccggctgaagctggtgcaggaaagcgggttaattgtcactacgcgggatagcctgtctggctggatacaacgtattgccacagatatgcagcaactgcgtcagtccggaatgtcagtcatctccggggatgttgaggtctcaggcacactgaccggccccccgtgttgtttccgggtactgtttttgatttatgcaacaaagtatcgcagcgtcgaatatgagctatggccagatttttgttaatcgtggttgttgcaacatgtaaggcgaatgaccacactattctggcacgctcgtaatcacgctgaaattccgcttcctgtgctgccgtgaagagttccgaccaggacatacggcgaagtgtatgtctgtcagtaatatccgtcatgagctctcagcctcctccttcgtatttccgtcagaaacacaaacgccccgcagagaaaattcgccaacattctcctttttaatggcgcgcaatgcatcgcgacaggcccgttcggtatgaaatgcctggctgtgcaccgccagtgtgggctgccgggcatcaccggaagagacattaaagggagatgaaagccagaaaatcagtagccacatgcgtcacacctcgtcctttttatgcgggtatctggccagaatattgagcgcctgtaatggagcttcatgcatttcacggatacaacgggcatcggtgatgttttccctgtaatgcgtggtttccagcatcatatgatgcatatgcagcatccgggccagggctgcgcggagttcttcaatatgttgttcatgggaatgctgacggggtggtatccggcagagagggataacctccacatcatccgggtgcgcgcgaagccacgcgtcagtaactgcaatgtcgtcagtgtaaaaccatgtgccggatgtcccgttggccagaaaacgcattttccaggcttctggggtggcggttgtgttgttatctttcatggtgccaccactcattcaacaggcttaatgctgtccaggcgcagtctgctcagactgtcgtggctgccacagcggcgtcctgtacttttgctgtagcactcctgccccctgatacaccatgccgttggcgtttcgtagaggctgacacgtcgggttttatctttactggctagaagcccggtgtgagtttttgtctttttcatcggtggggtacaaacgcagaaattttgttgtcatcagtttttgcctgcagaggcctgaaaagacagcgttttcaggccctgttcaggttagtgaatattcttgcctggcctttcggcaatatcaatccccagaagttgcatggatatcccatgcccattgagcatctggctgtccatggaatggataccacatgtcaccatcaggttgtaacaaagcgtactcaacatggcgagcgcctcttctgaggatttacaatgtgtgttcataagggccagaaactgctcaacaacatccgggttgatgctggtactgtgtatttcatccttcatgatgtgtccttgttttttattattttgcatttcagaaaataacacgatgcatgtaacccataaaaccgatatgtgcacgcgtagttactttctggcagattccggtctctgaaacaaaatacgtggtggcatgaagcggattgtggcggacagggaaagtgatttgattccggggaaggcgctgtgcagcagtcttatccggcagtttaaagggggggacggaaaccaatgaggcactggagcagattcagtgcagaggtgacctgctttatcaaacttaattgtgacaaaatggcgattgagaaggtgcaattgacttattcggattcggtcgtggcgaggtggtgaccctgcattctgctaaccgggttatgagtcaggagtcagcgatagacaaagggacttatctgaccgggcccctggaaaaatggcgggagagaatgataccttcctgctgacgagaccggactttgagatgacgagcgatagtgcggcagtgatgtacagcctgatcggtagctgcaaaacttaacggaatcgagccggaaacgtggctacgccacgtgatcagtgtaatcaacacctggcctgccaaccgcatgaaagagttgttgccctggaacgtcactctctctgtaaactaatttttaccccacgtccttcacggtgcgcttacactctggacaagtatgtaaatgataagttaaaaataatccgtgcatttcctgtgacgatattagttgttggtaacgaaatctcattagcggatcggaaatgcacttaacctaatacgttgccactgttccgccaggagttgcagtggcaacgtattctaccgtcagtgatagcgttttgttattatcagaactgatagttcagcgacatccagtaatttcgctcaggtatcacatatcctgttgttgatgatcccgtctggaagtaatcaccggcatacagcgtactcttaccggcactgtacaggctcacgtcactgtaatccttgttgagcaggttattcaccgcagcattcagcgtcagggcatccgtcatcttccacgacagacctgcatccaccactgtccaggctttcaggtattctcctttctcatcatacactttcttctgtacagcgctcagtgacgaataattctgggtgaaacgtggtgttttcccgcggtaacgggcacccagccatgatgccacctcttcggtgatctgccagttcagtttcgcattcaccatgtgttcaggggtataactcagcggcgcacctttgttatcaccatcacgttgttcacttcgggtccaggtgtaattcagtgacagcgtgacatcctctgaccacagcggcaatgtgccggcaaattccacaccgtgcaaccgggcctttccgctgtttacatagctattggtgttatcatttatggaataagagacaatcttgttggagaagtcagtcataaaacttgtgacattggcattcagaccggcggggttatcgtaatacaccccagcctcataactgacgctctcttccggcttcaggtcggggttaccaagtagatttgtttttccctgcccggacacaccactaatccctttatgtagctgtcccattctgggtgccttatatcccgtggtcacaccgcctttcagcgtccaggcatctgccacatcccagaccagatatgcacgcggactgaagtgtcccccgaattgctcatgatgttcatagcggctgcccgcagtcagcgcaagtgcatccgtgagatgccactcatcctcagcaaataccgaccagcttttctgccggaaagtttcacctgtgctggcaaggacaactccgtctttcatggacgagctctgaaactcgccccccaccgtaaccagatgagattctccctgaagataatttcccggttaaacagatcggagaactggcgacaggtaccacttttcccctgtaccgagaactctgtaacatccgctcccatttttcgttggcctttgtcaaagttccggctcaggatattgggcgcagatcacttatttggtggacaccactttgtcggatgcttcagattatgaccagatggatttcgctggacgcttacgattacatgcaccatattgtcaacgattacgccactgagtgtatgacacacattaaagcgttaggctcaggccttattacaatgtcatgctagtgggcttgtacgccgtaaatatctgcatgataccagaatgaccggcaaacaaaggtgccccgacaagctcgtcagtggatataaagaaaatcaagtgcgctgataacgatgccacatctgtggttggtggcaatatgcagattgttgttatttgtcttcattgcattctaagaagtgtttcttatcagacctgatttttttgccattatttttaatgaggtcttcaagtggaaaataggttaggcgttcatgtggcagcgcggcacgtccccatttagtggcaaactcccgttggcgtgcctgtaacagttgctccagcctttttattttgttctcattcatccggttttcctcgtatgctgcatcacaccactgtgctaatgaaaaatgtaatcagtgtggtggacgtgttttatccgcattggaattgtcgtcaactaaaggagatgaggcccgtttgtatcgcaatgggtctatggcgctcatgcccgtttgctgttcgataatggcttctctgagcatacggtgttgcagttctcgtaaaaactttgcgtcttctggtgataaatccattgttattactcgtaaagcaatgcgcagtaatgccttacgctaccgcgctgatggttcttatccgctttattgaataagagaacaaactgtgagctatcagcctggttttgcctgatttaagccgccgtgggtatttgtccaagaatgcttcaagctccaatcgttttggcctggtgaatagagatgggttaagcaaagactctcgttgctggtgtactttttcgcgctggcgctcaagcatggataatgcgattgcctgtagttcttcgttagtcattgtctgcacctggaaagcaatttaccggagtacctcacactacggcaaaaatgtttttattgttgcaacttgcgtaattattcaggtcagtttggaacgcactgtataaacataaataacctgatactgttgtgtgttttcaaagaaaacacaggtatttttcacataaaccttccctttttcatatccgaccacttaatcaaaaaacggttttatacttgttgcccccctcaggggttaaatgtgagacatgtcgcgctttgtgccatgtgtcttcactgattttaggcgcggttcattcattctttctgttggcataaagtatggtatcggttgggcgaatgaaagggactcgggtcatagtcagacaatacctgaggcgttaattcgttgaaagagattgtgaatgggggaataactgagtcttaactgctgtgcgattgcccggacagataattgctcgtcaaatctgagacgtaatgcgtctggaaaataagtgcgaaagccggtgatatctagtgttgtttgagagttcatcgttcgagcccatcaatatagatgggcgcgattgttgccagacaggacaattttcacaagacgtcgctgatggggcgcttacaagaaaatgaaatataagagaagagcaacgggtgaagaaaagttcaaaaaatggctgcgggtgaccggatggaaagagtcccccctaaagcaggctgacagacatcacaaatctccggctggttatttgtgtataagagacagctgagctggaggggaccttttatgcgctatttttatgccgaatccgctaaaacaaacatcccgtaaggatggatttcgaggtaatagtgctcaccagtatcgggctgtaaacgagtggcgttgacttgcaataaaatctcctgaccatgccattctacggtcacttcgtactgcggccccatgtaagcgacatggcgaataacacaacgctgactctcttcgccgtgattgcttaaggtgatggcttccgggcgaacgccgacggtgcctctaccttgcaccgggaaatacgccgcgcgcggcaggcgataaccgtagatatcgacatactcttcgctaaagttcgccgggaacaggttggcgtcgcccataaaacttgccataaagcgggaggcgggctgacgatagagctcctgcggtgaaccgatctgcatgatgtgacctttattcatcaccagtacagtgtcggataccgcgaaagcttcactttgatcgtgagtcacgtagagcgacgtgatattaaactgcttttgcagctcgcggatcttatcgcgcatactgcggcgcaggttggcatcgaggttacttaacggctcatcaaacagcagcacctttggcttgaggatcaacgcacgggccagagccacacgctgttgctgaccgccggaaatctgatcgacatagcggtcttcgaatccttccagatccaccattgccagcgcatctttcacccgctgcttcacttcattacgcgacacgccaagcattttcagcccatagccaacgttttcgcccagcgacatatgtgggaacagagcgtatgactgaaacaccatgcagatatcgcgttgctgaatggaacgatgcgtgacatcttcgccatctataaaaatttgcccttcgctcggtttttccagcccggcaaccagacgcagaatggtggttttgccgcatccggaaggaccgagcagcgtcaccatttgcccttgtgggatggtgagattgatattgtcgataaccatattactgccgaatcgtttagtgacgctgcgcagttccacaaaatttttctgactcatagtgcgctccattacgcctggtttttggctttagaacgggaaatacgtgcttcaccgatcagccagtcaaagaggaaaataatcgccagcatcaccacgatcagaatcgaaccgtaggcgatggctacgccatattcgccgtcttctacgcggttaaggatgtaggcggttgccacgcgggtgtccggcgtgacgagaaagacgatggcgctgaccgtcgtgatagcccgcacaaagctgtaaatcagggccgagagaatagctgggcgtaataacggcagtaaaatgtgcgtaatggttcgcagggaacctgcacgcaggctaagtgaggcttcatccagcgatttgtcgatctgccccagacctgcaatcccggcgcgaatacccaccggaacgttacgcatcaccatcgagataatcacaattgctgccgttccggtgagatagactggggcgctattaaaggcaagaatatacgagacacccgccactgtacccggtacggcaaagcacaacatggtggtgaactcgatggtctttttgcctttgaattgttggcgcaccaccacccaggcgatgagcaggccaaaaatagcggtaatgggtgcggcaatcccggcgtagagcaaggtatctaacagtgaaggccacgcgccgtcgctcatcccctgaccaaataacttgataaagttatccagcgtcagggtgtagtccacgccccagttcacggtgaagctgccgtagaaaatgctgccatagagcagggcgttaaaggcaatccatatcgcaagtatggcgaccacgctacacaccagggtgaccggtagtggctggacatcgccgcggtaggactttccggaaaccgtgacgtaagagcgtttaccaatccacatatactggacgcagaacaccagtagcgagaacagcagcaggaaagcgccaagggtgctggcggcctgataatccagctgcgagccggtaatgtagaagtaaatttgcgtcgccagtacgtcgaagttgccgccaagcaccagcgggttactgaagtcagccagtgactgcaccacgacgattaaaaaggcattggcaagcgcgggctttaacaacggcacaaacacaccgctaaaggtttgccagcggctggcgcgtagggtgtaggaggcttcttccagcgagggatgaatggttttaatggccccatcgaggatcataaaagccattggcgtaaatgccaggacctgtgccagccagatcccggtaaaaccatacagccagttggtgttggtcagcccaaaccactccaccataaattccgttatgtagccggagcgccccatcatgagcgtaacgcctaagccgaccacaaacggtggcgtgacaattggcagaatggaaaagatgcggccgattacggcgctgcgtttagcgatgcgcgtggtatatatcgccagcaccagaccgaagaaagtgcagccaatacccaccgctatcgataagacgatagagttgacgatcacctgaatgatatgggcctgcgagagcacatttataaacgccagtggggcgaactctcccgcgtcgttggcgaacatcgggataaaaatggcgatgctcggccagacgataaaaatgccaatcagcgccacaatcgcaatcagcgagccgatcacaaagcggtcgccacccagccattcgaggcgggttaaggccagcgtcattatcgcgcttaattcgataaacagcacgatggcggcgtagcctagaccgcggccaacgatggtggcactgatgaccataaacgctatacaaagcaatgcccagccggcatcaaaataatgacggctacgctgctcgcgtttggcctcattaaacgggcgaaccagcagcaaactcgggagtaaataccacagccagctgatattaaaatgcgaccagctgtacgcctcgaggatctcatcactcgtggactccagcagaccataatcgaggctccagctcggcaacaggataaatgccagccagcccagcaaaacccaaaggaaaatcgcatcccgctttttcgcgggatggagtgcaagtgtctgtgacatagcagttccggtatggttggccggggcaggcgtctgtgctgcacccggcaagtgcacacaatacgggtttatttacccatcttcacttcgctgacccatttattaattaatgccttacgaacatcagttgaaccgtagttatccatgtcgtagttgattaatttcaggtcgtcgagcttcagcgaatttggcgacgtttcggcggtggtattggtcaggatctgataagatttccctttcttccacgccagttcttgagcttcttttgataatacccagtccacgaacagtttggcgttgtcgaggttgcgcgcacctttcagaatgctgacgccgcctatttcgtagcccgtaccttcacacggggaaatcaactccagtggtgcgccctgttctttttccagcgagtagtcatgcaggaaaccaataccaatcgccgtttcgccgcgggcggcgttacgtgccggggcaatgcctgatttggtgtactgggagacgttggcgttaagttgttttagataatcaaaggcctgatcttccccccacagctgcgcaaaggtagccagcgcggtgtaggcggtaccggaactttgtggatcggcaatctgaatttcgcctttatattcaggtttggtgagatctttccagcacttcggcacaggcaggtttttctctttcagacgctctgtgttgacgccaaacccgaggatccccacataaacggcggaggaaaggtttcctttcacttttgccggatcgcggaatttttccatgatctgttcaaggttaggcgatttatatgcctgtaacaggcccatctcgccggcctgcgactgcgggtctaaagtgccgccgtaccagacgtcagcctgtgggtttttcttttcagcatcgacttttgccagggtgctaccggagccgttgcggataaacgaggttttcacatcatatttctcgccaaactctttggtttcggtctcacacatttcattagtggcgctgcaatagaccaccagccggccttttgcctgcgcggcacccgttaaggttgctagcgcaacggcagaagcaatcagagtagaggtaaggggcattttcattgttttatccttcgagcgtgagtggtggtgatgcccgccatcagtaacggcatcagcagtaaacccataagtactgcggcgaccgagagtaaactgaacattcccgaccagccgtagcgttcgataaccagcgacaacggccagcctgccagcgccgcaccgagataggcgaacaggccgagaaatccggtgattgaacccgccgcagctttgtgtccacattccactgccgcaagtccaatcagcatttgcgggccaaagacaaaaaagcccacagtaaaaaagcacacagccagaagggcatagtgatgaaccggtgccaaccagagtgcagcgaccgaaaccatcaacccaagggtaaacagcaaaatcatgggggctcgctgcccgctaaacagcaaatccgaaccccatccggcaaataacgccccgagtaagccgcctacttcaaacagcattaccgtggcgttggcgctgagcaggttgacgccgtggctttccgtcagccagatattgccccagtcgtttagcgcaatccggatcacataaacaagtacataagagacacccagtagccagatcagcggattttgcagcatggtggtgcgcaacatttgccacagccccatcggcggactttgttgttcctgacgtaactccagcggatcgtgacgccagtgaccaactgtcggtaatccctcttcctggggcgtgcttttgagttgtagcgttaaccagatccctaatgccatgctgattatccccggtgtcagcatcgcggcctgccagccccaccagtgggcggcaaaggcgctaatcagcggaataatcgctccgccaatgttgatcgacatattccagcagccccaccagaaaccacgttcattacgggaataccaatgggtcagtaagcgggcacacggtggccacccccagccttgaaaaaatccgttcagtgtccagaccacaagcagaagcgtaagtgattcgccaaaggcaaacaccacgttcaatagcccagtggcgaacaagccgatacccataaaaccgcgttgtccgtggctgtcatgccacagtccggcggtaaatttcgacaatccgtagctgagataaaacagtgaacccagcaggccaatgtcgcctttatccagtccgaggtcggtttgcagcgccggaaggacgtaattcacgctttttcgcgtcagataaaatgcggcgtagccaataatcatgcacatcagcaatcgtggacgtaatgtccggtagcattgattaatctctctcgctgaacgcgcgtgcatggtcgtctccatgttgctgactatatgaaaatgaaagtgaaagaggatgagagaaaatccgggatgactaagactttttcctggttatccggcgatttgttgcaaaaatgtgggcaggttaacaattacccgcgtaccgttatgtttttcgagcgttaagtcgccgcccagggcactgacgcgttcacgcatcccctgaatgccaaatccggtcattttcccgctggcaatccccacaccgttgtcgctgacctctaggtgcaatatctctccctgctggcgcagaataatcgtcacttcgctggctccggcgtgtttacagacattattgagtaactcctgcaataaccgatacagtgtaaagcgaaccgtttcgttttctggcgtggtggttagttgataggtaaactggcaatgaatgccgagttcactaaaggcaaattcattaatcagatgaagtaatgcttcgcggaatgtcagttcatcaagcgcggggggccgcaactggcgcagcaactgacgggtggagagatgaatgcggcgggcgagttcgttgatttggctggctgcggaatgaacttgcgccggatcgcgtgcccgcgtcaccagttgcgactggatctgaatggcggtaatgttctgaccgatttcgtcgtgcagctcgcgagccaggcttttacgcgtgtcttcctcggtatggatcagcttttcagccaatgcccgccgtgctgccagttctgcctccagtcgctgacggtaatgatgcaggtttagcgccagatgttgctgccgactaatggcaatgcccaggccaattcccagcaatgcctgggttgcgagaaaaatctccagttccaccaggttactaaagcccacaccaatctggcgggcaatagtgatcatcatgctgcccaaaagccccgagagtacgcccccttgccagccaaatttccaggccatgactacattgggtagaaataccacgatcagcagcaggcgttcgatttcaggcgacaacaccatctgggtgccgataccaataataaaaaacaggctacaccagatgattaaagaggttcgcaaggggggattatgcgtatcgagtctcagaagctgatagcgatgctgctggcgcagaaactcaaagataagatagacaaacggcgtcaacaatacgccgccggtaaatgaggtcagaccgggcagcattattgggcctgacataaaaggggttagcatggctgtattcagcaatgaagctgctgttactgaggctaacagcaacgtcagacgctgccagtaaagtggaaaacggtgccagacgttttgtgcaatgatggcaggaagcaggctaataaccggcgttgccagcatgagatagccattcaacagttgctcgctgtgcagccagaacatcatcagcaaaggggggagcaccaacgcaggccaataacggcgagagtgcaaaataagaaaagcgaggtaaactccgtgcggcagaaataacactgcctgttgaccgttattggtcagataaaagctgagcgtccacaacatcagccagccgcttccccaggccagcacaataaacagcgaaatcacccaatgacgaaggttacgcgacattaatgccccgccagcagatggtggttgagtgcaaaatgcaccagctcaatggtgctatgacagttcagttttcccagcacgttggcgcgatgtacatgtaccgttttatggctgagttcgagcttaaaggcaatctcttttacactgtcgcctttgactaataaatcaaacacttcacgttctcgtggggtgagaatttccagtgcctgggcgggttgcccgccgccgcgtaaagcccgaattgcatcggcgcagagataatgccctcccataccgacagagcgcaccgcctgcactaactcttccggcccacagcgtttggtcaaatagccactggcaccagcatccagagcgctttgtacaaaggttggcgtgtcataaatgctaagaataatggcgcggaattgcggtttttgtgcacgcaggcgcttaaccaaactgaggccgttttcgtccggcatagcaatatcaatgacggcaacattgacgtcatcacagattaatgccgaccatgcctgtgcggcactactgtactgaccaatgacctccagatcgtcttccagagagagtaactgtgcgaaaccagagcgcaccaccacatggtcatccaccagcacaacccgaatcatacttttcttctcttattatctcattctcctatcatgcatcacgacgcgtcgctggcaatcaaccagcgacagatatggaatggatgtaacaaaaaatgtaattggttattcaatataattatgctttatttcatgagtggctctatatctggtgttcagattattgtctgcaggggcagttcagaagatgtgagcaaataaaaaagaaaacataaataaaaccatccggcctccaaagccggatggttattcattatttctgcatcactgaactttcattcatcaggcctgctcagaaagtgaatcaatgtagtcagcgtaccattgcatcatttcacgacgaccatcgagatactgtgcgtggttgtaggtgccgcgcatgatgtttttatcaacatgggcaagctggagttcaatccaggcagagctgaaatcatggtcatggagaatggtactgaaagtatgccgaaaaccatgagctgtagtgaatgtatgccagccaacttgttgaagaaactcgttgatgcaaccgcgaccacgaggttgattatctctgtatacaccaggaataaccagctcggagttacggggagctgtgattatttttatctctttcaataacatttgagtctgatgagaaagtggaacaacatgcggccttcgcattttcattctctcttttgggattacccataaggcattggtaaaatcaatttcatcccaagtagcaaggcgtaattctcccgttctaacagcagttagaaccagtatttgcgttaccagagacataaaattgcctgaaactttcatttggtacatgaaagcgcctaactgttcttcagatagcatccgtctctgctgtttttctggatgaagaacaacactgctgagagtcgatgctgggttaatagtggcgcgccccgtcgcaatggcgtaatcaaatatttgagaacagagctgacgagtcttacgtaacgcttcaagtttgccattcttttctataaccctcagtgcattcaatatttccaaggggcgaatatcagccacaggacgtttccctagcatgggattaatatgattctcgaatcttgcacgctggtccgctaaataacccgcagtccaacgacaagccatatgtgtgaacaactcttctgcaagagtacaaaatgtgcatgcaatactttctcttagtgcatgtttactcgcctgtttttcatatgaaggatcttttccttcagcgaggagtttacgtgcttcatcccgtttctgacgcgccagagccagtgatatacctggatagacaccaatcaccaatttcttttctttacccgcaaatcgatacttcagattccagtaacgagcgccagatttcttgataagaaggtaaagtccttgaccatcagaaagtttgtaatccttgtcagcaggtttggccgactcaatttgccgaacagtaagtggcatgatgttaactccgaaaagtagcccccagagtagcccccaaaattatattgatgatcatggaggatggtttacgtccagagtaaaagaatttatgacaataccttattttaaagtgagttaaagggggtggagagagttctgttgaaatcagtggaaataaacagggcttaataaatcctccccgctgaggagtgctggctggaacgactgcaactggcaaaaacgttaggcttcgattttgtcgagatgtcggtagatgaaacggacgatcgcctttcgcgcctcgactggagccgcgagcagcgtctggcgctggtgaacgcgattgttgaaaccggcgtgcgcgtgccgtctatgtgcctttctgctcatcgtcgtttcccgctgggcagcgaagatgacgcggtgcgggcgcaggggctggagattatgcgtaaagctatccagttcgcccaggacgtcggcattcgcgtgatccaactggcgggctatgacgtttactatcaggaagccaataacgaaacgcgtcgtcgtttccgtgacggcctgaaagagagtgttgagatggcaagccgtgcgcaggtcacgctggcgatggagatcatggattacccattgatgaactctatcagcaaggcgctgggctacgcacactatctcaacaatccgtggttccagctctacccggatatcggcaacctgtcggcgtgggataatgacgtgcagatggagttgcaggctggaatcgggcacatcgtcgcggtgcatgtgaaagacaccaaaccaggcgtcttcaaaaacgtgccgtttggcgaaggcgtagtggatttcgaacgttgcttcgaaacgctcaaacagagtggctattgcgggccgtacctgattgagatgtggagtgaaacggcggaagacccggcggcagaagtagcgaaagcgcgtgattgggtgaaagcgcgcatggccaaagcaggcatggtggaggcggcataatgcaaaagctgaaacagcaggtgtttgaggccaacatggagctgccgcgttacgggttggtgacctttacctggggcaacgtcagcgctattgaccgtgaacgcgggctggtggtgatcaagcccagcggtgtcgcctacgaaaccatgaaagcggacgatatggtagtggtcgatatgagcggcaacgtggtggaaggggagtatcgtccgtcttccgacactgcgacgcatctcgaactctaccgtcgttatccgtcgcttggtggtattgtccatacccactccactcatgccaccgcatgggcgcaggcggggctggcgatcccggcgttaggcaccacgcacgccgattacttctttggcgatatcccgtgtacgcgtgggttaagtgaagaagaagtgcagggcgaatacgagctaaacactggcaaagtgattatcgaaacgctgggtgacgccgagccgctgcatacgccgggaattgtggtgtatcagcacggaccgttcgcctgggggaaagatgcccacgatgcggtgcataacgcggtggtgatggaagaagtggcgaaaatggcgtggattgcgcgcagtattaacccacaactgaatcacatcgacagctttctgatgaataaacacttcatgcgtaagcacggtcctaacgcttattacgggcagaagtaaaacacgcgctgcggaaatttccttcttcgggagataactggtctaattccgcagccgtttttcaaaaaaaagccccctgcgaagggggcaaagcaaactatggcaatgtttcgttggttatacctggtgctagcgataaatatccgcgctggcgtgcatattgccgttactccccggttcccgcatcagaattacgtggtagtacgttgcgccttgcgcatctgtctcttcatttaatgcctgacgtgcttcactctcagtggcgaagttatgattgatataaatcacgcctaagctttgcacatcgtccatatttctggcctggtggttattaatttcaatggctgcccatgtatttgcacttagcaaaagcacagccagaagggctaaaacgcgactgaacatagatacctcctcgacggctgactttgtgtgctctcctcttgtggtgatcttctgatttaattttaatcaatgataaagaagttgatggtgaccatttctgatgcagttgttcaaaaaaacaccatgatgaagcgtgatgaactccaaatcagcgatttagaggttatttgcgaaaggggcgatttatttctgctcagcccttgagtttagcggggtatgtcagtattataacgcgtcatttttcagccgacctttaacacgttccttgcctccccgggattcggctgacccagacaggaggctgaataatccgtaaggagcaattcgatgcgtcattacgaaatcgtttttatggtccatcctgaccagagcgaacaggttccgggcatgatcgagcgctacactgctgccatcactggtgcagaaggcaagatccaccgtctggaagactggggccgccgtcagctggcttacccgatcaacaaactgcacaaagcacactacgttctgatgaacgttgaagctccgcaggaagtgatcgatgagctggaaactaccttccgcttcaacgatgccgttatccgcagcatggttatgcgtaccaagcacgctgttaccgaagcatctccgatggttaaagcgaaagacgagcgccgtgagcgtcgcgatgatttcgcaaacgaaaccgctgatgatgctgaagctggggattctgaagagtaatttctgatgaccaaccgtctggtgttgtccggcaccgtgtgcaggactccccttcgaaaggtcagtccatcaggaattcctcactgccagttcgtgcttgagcatcgttctgtgcaggaggaagccggctttcaccggcaggcatggtgccaaatgcccgttattgttagcggacacgaaaaccaggccattactcacagtataacggtcggcagtcgcataaccgttcaggggttcatttcatgccataaggcaaagaacggactgagcaaaatggttttgcatgccgagcagattgaattgatagattctggagactagccatatggcacgttatttccgtcgtcgcaagttctgccgtttcaccgcggaaggcgttcaagagatcgactataaagatatcgctacgctgaaaaactacatcaccgaaagcggtaagattgtcccaagccgtatcaccggtacccgtgcaaaataccagcgtcagctggctcgcgctatcaaacgcgctcgctacctgtccctgctgccgtacactgatcgccatcagtaatcggtcacggtccattaatacgactttgagaggataaggtaatgcaagttattctgcttgataaagtagcaaacctgggtagcctgggtgatcaggtaaacgttaaagcgggctatgctcgtaacttcctggtaccgcagggtaaagctgttccagctaccaagaaaaacattgaattcttcgaagcacgtcgcgctgaactggaagctaaactggctgaagttctggcagcagctaatgctcgcgctgagaaaatcaatgcactggaaactgttaccatcgcgtctaaagctggcgacgaaggtaaactgttcggttccatcggtactcgcgacatcgctgacgctgtaactgcagctggcgttgaagtggctaagagcgaagttcgtctgccgaacggcgttctgcgtaccactggcgaacacgaagtgagcttccaggttcacagcgaagtattcgcgaaagtgatcgtaaacgtagtagctgaataattcgttattcaacgagacgtaaaaacgccgaccagtggtcggcgttttgcttttaagtgataaaaaccgcagaaacagacgttccctccataaatctcttgctattccttttataaaaatttcgcagtacccatacctggcccccagcctcgccgctggtagttcgtgtcatgttttttacgcgtaaaacacgacaaaagcatcaatacagcgatcgtctcacttgtatgataataaaaacaatatgttatatatgaatgtgctgttattttattgtttttatatataaaaagataaaataccatcactttcgtaatcttgaacgctttgcaggtgcgttcaatccaataaatgctaatattatggctatcatagccataaaaagataaaatattatcactatgggtaaaaaaacagcaccgttactcccttatacgaatcagatgcttagtgaatttggtgagcggctgaaacttgctcgtttacgacgcaggcttaccgcaaagcaagttgctgaacgtgctgggatgtcgccaataacattgcgctctctggagtcaggaagtgcaggggtcacgataggggcatatttgtctgtaatgcaggttttgggcctggaaacggatttaaataagcttgcagctgaagacgacttagggcgtcagctccaggattcccgtttgattaaaaaaagagggctttctcgttcatcaggtaaaaatgaagaaggtattcagacagacccttttcaaacgaggtatgagaaagaaggtttactcaccacggatttaacagcactggcagaaggctcaacgccatctattacaggagaaacatcaacctctcttgcagcactattaaaaccgataaaaaaaccgttaaaaggaaattaattatggcattaatcggagtgtatgcggattgggaaggcctggatggtccggagcggattggttatttacacagtcgccgcactcggacgcgtgagatatttgagtttgagtacgataaaaaggcgcttgcagatccttcacttaatttcattcagttagatcctgaaataatgttgtatgagggagcacagtacccaattcctccaaaggataaatttggtgcatttagtgattcctgcccggatcgttgggggcgtatgctaatgaagcgtcgttttgagagggatattcgagacgggttatgtgataaagactcccacctttatgagtctgattatctactaggtgttcatgatctttatcgggttggggctcttcgatacaaacgtgaagacgctggagagtttcttgataatcgcattgatgttgcagccccaccatttaccgaaatagcgagtctggaaagggctagccgggcaattgaagaagatcctgataataaagagctaatggggcaaaaatggttaagaatgctaatcgctccggggggatcattaggggggacacgtccgaaagccagtgttgttgatgaagctgggcatctctacatcgctaaatttcccagtgtaaaagatgagtatgatgttggtggatgggaaatggtcgttaatgcacttgctgttggctgtggactgaatgttgcacctgctcaggcgcataaatttgccagcaattaccattgttttatggttcgtcgttttgaccgcactaatgcgggaaggcgtctgcattttgcttcggctatgacactaaccaggcatcaggatggtgaagatgcctctacaggtgtgagttatctggaattagcagatgttcttatcagacatggagcgcagactaatactgaccttaaggaactctggtccaggattgtttttaatattcttgtttctaataccgatgaccatttacgtaatcatggatatatcttgataccgggaaaaggttggcggctttctgaggcatatgatttgaatcctgttgccaggtctgacggtctaaaactcaatattacagaaaatgataatgcacttgatttggaattagctcgagaagttgcggagtattttcgacttggtttgacagaagcagatgacattattgctaattttagagggattgtcagtcagtggcgaatcattgccgagcgtcttcgattacctggtcgtgagcaagagttaatggcagaggcgttcaggggggcaatttagaatagttatttagatatattcgctaaatcataaatttgcgaagcaatgccagtagatactgaacgttttggaagagacgtttaatttatgagaaaaatagaaacgctacaaagctaaattatagcgtttctatgtaaaataattagcttgtcgctaactgtacttgtggttcttcgtctttaactttgataagcatccacagcgcaatggcgccaataatgtcaaagaaagccagggcaataaagaacggcgcgaagccaataatgtgaacgaatgccccgataaacaggttgaaaatcaactgaccgctccatgcacaggctcctgccatacccacagcggtagctacttcgtcttttttgaataggtcaccgcccagagttgctgcaacagtagaaagacattgatgcgagaatgcgccaatgctaatcagtaatacggcgatgtagggattttcgacaatactcaccagaccaatcgtcatcataatgacggctgcaatagtgaaggtaattcttcgtgagttaattaaactcacgccgcgatcgtggaagaacttcgcgacaaaaccactggctaaacagccgagatcgcccagcaggaaaggcagccagacgaacatggcaatttctttcaggctaaaatgcagcgtttcgacgaagaaaatcggtacccagaagttaatggttccccatgccgggtcagcgagaaaacgcgcgatgccaatcccccagaaattacgttggctgaggatatgcttgattgacgttttttctttcttatctgttttaagatgctgttcttgcccagactcaatatagtggcgctcttcatcagaaaggcgtttagcatcttttggatctttataacaaaagaaccaaaataaagccgcgagtaaagcaaggctacctgagacaataaacgcaaattgccagctatgaaacataatgcaccaggcaatcaacggtggagcaagcatcgcgccgagtgaggtacccatattgaatacacctgtcgccacgccacgctcttttgccgggaaccatgttgatgcggtttttacacccgcaggaattgccgatgcttcgctgaaacccatcagggcgcgcataaatgccagacctgaccatgttcctgtcaaggcatgccccattgtcgccaggccccagattgcggcacatatcgcaaaacttaacttcagacccacggtatcaataaagaagcccattatcggttgccccaatgtataggccaactggaatgcactgacaatccatgaatattgttctttggttattccggttgtctccataatcgttggagccgcaatacctaacgccgttctgtccagataattgattacagtgataaagcatacgagggcaatcatatgccatcgataattctttattttattcatttttaaaccttttaattatattaataaaccctggttgttggtatttccatgtaataggcaataaaaatcaggtacagaggaaatattgaaaattattgtgtgtaaatgtctccctttaaaaagtctggccagtttttttcaaagtaaataccgttaatacacggttgaatacgtaaagactttacttcggtaataaaagaaccttgcgaatattgaattgttaatttgtgatttttgtcttcagcgagttcagagcgaaaacgccattcttcttttgcgccgcgacgagtttgtggtaggcatttgccttgtggatcaataaccatacgcgccccacggctaccaccacctgtatcaatataatgtgtcagttgagttaagacggcggcagaagtcagcgtcatatgccgccacataaacagctcggcaacttcacccacatgtttgattgccaatccatgtcgttggacaaattcgttcaatagcagggcatcacgagtggcacgtcggactttatcggcatggcaaataaatcccgcatagtcagacattcgtgcctgaattttttctctcacaaccgacaacggcatcccggacccgttatcgtgcgcctgagtaatgatctctcttatagaagccagtgccggagctgccagctgtgcaatatctccatcaatattccgcttttgcgtgcaaccaataaagcgcgccagacgaacagcaaaaacctgcccggcattcaacgccgcgccgccaggtcgggtgacgccgtgtgtgccagcaacttcccccacggcgaaacagccgggcagggaggtttgtccccagatatccacttcaatgccgccattcatatgctgattattcatggcaaactgcaatggctgcgtggtgagatcgtaaccgtgcatcttatacagcgagatagacagcggattcattcgttgcagtcgttcgatgggcgatggtgccagagcgtcgttattttccagatacgcgcgaacgtcgtcgtccagtcgatctaatgagaacggcatgtcacccggcacaggttcaggattgcgattgaaatccataaatacctgacgccctgattgctgctcttgcgctactgccatatctaacaagctggagccaaaatccatcactcgtgtggcgtgaaacggccactgatagcctttacggaaaatgtttgaagccagctcctgggtggtgcgatagtaatccgcgaggaagttatactcgttaccctcagcatccacggaatagatatacgggatcacctgtacataggtgccggataaattccacggaaacgtgctacgcggcgtgcctataccaaactggctttcggtcagattggttagcgtcaggccttcctccagcgccagccccagcgagccaaaacatttgtgtgggtacacactgtcgcgataaagctcgccaggccctcctgttgccagtaccacattgggcgcagtcacaattgccagcccccaagggttatgggcgcgatgaccggtcgcgaggattgcccccgccacacggtcttcgccgttttcgtcacgctgatgcagcagtttaatcactgttgcactggtcaacactggaatggcgaggcgctgtacttcttccaacagcactttcaccattaaccttgaggtccgcggcccacacgaggttgcacgcccggcttcgtcatggtcggtttgataacgaagaatcgcgccatagcgatcttccggtaattccagaccaagatattgcaacccgccaagagtgtgcagagaacctaccgcttcgacataagcggtgtcgtgatccatcgccccaccgctcgccagtgcctctgccagtttggtgaagttgtcgccattgcccgcggtagcggcggtaaacagtgtctgtttatcggaaccagaacatgccgacgtccccatatataacccggcgctggcgattagcacattttgctggcggcgtttaagttccacagctgcacgcagcccggctgcaccactgccgactaccagggcatctgtttgccagagtgggtaatcaacaccgtctaccgtgacaacccatgcgggctctgcctgtgcaaaaccctttgggaaagtaacgtgcgtcagcgcatcaaggatggtgtcatcaagctgactcatgcatcctccatcggcgtaaacaggctactttccatcaggcgtgggtgcttgataattggacggaaagccatatacggcagaatgtcgcgctcaatctccacacccgacgcgatttcaattaattcaacgccttctgccgttaactggaatactgcgcgttcagtgatatacaacacttcctgaccactttgctgtgcgtaggcggcgctaaaagtgattttttccacctgggtaaccagtttagggatttgacctgactgggcgatatgcaagccatctggcgttacatcaatcttgctacctttggcgtcgaacgtgccgcagaacaccactttacgggcgttttgcgcaatttcgagaaaaccgccgggaccaatgagattgccattgagatgggatacgttgacgttaccgtactgatccatctctcccatgccgaggaaggtgatatcgatccctccgccactgtagaactcaaattgatcgagtgatggaataatggcatcggcgttgcgggcacaaccaaacagagcatcatcaagcatcatgccgttatgtacgccttgctcgacgctcagccataaactttgataaggcacgccttcgcgcagcgcaaccccaggaataccgcccggaataccaaagccaaagttggttgaagcgcctgccaccagttcccgcgctgcccgacgggcaatcaggcgacgcaccggatgactaaccagttcaatagcgtcgttagaacttagacggcgatgttgaccgctgatggtcaggtcgtaaccgccaagataggtttgcggttgttcgcggtgctcaacgatgccatcgaccagaattcctggtagtttgacccgacgtggttcaatggtacctgcttccagcacatcgcggacctgtacgaacactttgccgccgctgttgtgtgctgccagcgccatcgaatagctatccatatcaatcgcctcttcttcgaggctgacgttgccacgcggatcggcataggtgccgcgcaaaatcgcgtagtccactttgaaagggcgataacgaagtttggtctcaccgtcgatttcaatcagttctaccaggtcgtcggtagtgcattcattcgacttaccgccaccattgcgtggatcaacaaacgatcccagcccaacgtgggtaaaaagccccggacgtccggcaccgatctcccgcagcagtgcctgaattacgccaccagggaaacagtaggcttcaatagcattgcttttcaccagttcctgcatcttgggcgaccaggtaaaatgtccggcaataatgcgtttgagcatttcggcgtgagcaaaacggttagtgcctttgctgtcgcgatcgccaatacccagcgagtggattaatgtcagatcgcgcgggtgtccggtttgcagaaagcgcgcttcaatggcggccagaatatggtcagcttccaccatgccgccgccgttaccgctaatggcaatggttgcgccgtcctgaatttgcgccgccagtgtctcggcggttgataacttacgcatacaatttccttattgattgtggaagctcacgccggctttttcggcaaatgcgcgcgtcgcctgctggcaatcctgagtggcggacattaatccagccagcaactgatgcgagtaatcggcgtgtttattttccagcgtcagaatcagttgtttaatgtgtgccagtgccaccggaccacatttttccagctgcgctaactggttcgccatccagctttccacctgttctttttctaccacttcatcaattaaattcgctgtctgagcttcctgcgccgtcaggcgtttacccagcatcagcatctggcgaccgaccacaggaccaacctgattaagcactcgctcaatgcccatccagcctggcaccatgccgagcatcacttccgggttagagaatttcgcgccggggcgagcgatacgaatatcgcagcacaaggcaagttcaataccgccaccgatggtatgaccgttgagattcgcaacggttaattggggtaagttgcgcaggcgattaaaaacgtcattaccgcatttaatccattttctgcccatatctaatggcgaataggccgaccacgatttaatatcgccgcccgcacaaaagaatttatcgccggttgccgttaattcgactaagcgtaatgccgtgtcattttcaatttcatttaaataatggtcgagagattcgatcatttcttcattaatagcatgacatttatcttcacggttcaatgtcaggcggcaagaagccgccgctctgctgaacagaacgggttggtcactcatgattattccttaacaataatgtgcgatgcgatcgacgctaatatccagcgtgctgttaatatctttctgccaccagtacggtgagaatatttccagttcaatagcgccattaaatccggcgttttcaaccagccgacgaattgacggaatattgatgacaccatctcccggcattccacggtcattgaccagatcggtggtcggcactaaccagtcggaaacatgaaacgcgaggatgcgttttccggcacgcaggatctgactggcgagatccgggtcccaccagacatggtagacatctaccgccacgccgaggccaaattcgccatcgggatcgagttcatcacaccagtccagcgcctgacgtaacgtgcacagacaagaacgatcggcagcagtcatcgggtgcagtggctccagtgcaattggcacgccgacctctttcgaatgtggcagcaactggcgaatcccttgtttcacctgttcccgtgcttcgtacagatcttttgttcccattggcagaccgccaaccacctgcatataacaggcggcgttcagtacagcggcgtcgtccagcgcccggcggttatcgtcaatcgccagtttgcgctccgccagcgtcggtgcggtgtagtaggtgctacggcacaaaccggaaacgttcatgttactggcagcaagctggcgggcgatttgctggagatcttcactctgcaactccctgcgccagggggcaatcgcgccaataccgcgtgcggcgcaggcatcaataatggcgggtagcggcgttttatagcccagtgtcgcggtattgatactgaataaatccgggcgttgtaacagatctctcatgattcagcctcagaagcgcggcatacttaagccgccgtcgatggcgaccgcctgaccacaggtgtaaatcagtttaccttccgccatcgcgcggacagtggaagcaatatcagccggataaccccaacgtccccacggcaccagacctttggcaatcagttcgtcgtaataggccgttgccggaatagtcatatcggttttgatgagaccaggacgcacttcatatacgccaatttgttcattacaaaggcgagcagcaaacagacgagcagcggcagagacggcagttttggcaatggtatattcgccgcgattcatcgccagcatgatggcgttgatggaactgacaaaaataatcgagcggtgcggcagttctgcttccggtttcggctgtgccagtaagcgcttactgaatgcctgagcaaggaagaacggtgcgcgggtgttaatggcaatattttggtcgaagctgtctggttcgaggtcgagaaggtcaccgcgttttttcactgaaatgcctgcgttgttgagcaggcagtccagacgtccccactggttttgcgctgcgtcgagcatctcttcatgcagggagagatcgcccacatcagcagggaagcaaatcacttccacgccttccgccagacattcttgttgtgtggcatgtaatttttctacgctatccgcatccggacgatcattaatcagcagattaaatccgccacgcgcaagctccagcgcacagccctttccaataccacgtgcggctccggtaatcacggcaacaggacgagtggatttcatacaatagctctctttttttgaattttgtttccttagtgatgattagcttgcgactggaggataaaaagatcaaccatctagttggttgatatgcgatggcgatcacaggacatttgataacctgatgaaagtacaagtttttgcccttttttctgaagctgaaatcaaatcaggttatgatagtcaccacgaagaggtcgtggggaagcgttatgtatcttgataccagcaacgtacagagcctgaaagaaaagctgctgttatgcgcggttaatgaatttgccgaatatggttacgaaggggccagagtcgataatatcgtcaaggccgcggggtgcagtaaacagacggtttatcaccactttggtaataaagaaaatttatttatcgaagtactggaatatacctggaacgatattcgacaaaaagaaaaggcccttgatttctcagatcttccgccacaaaaagccattgagaaaataatcgattttacatgggattattatatttataatccctggtttttaaaaattgtgcatagtgaaaatcaaagtaagggtgtgcattatgcaaagtcacagcgtcttttagaaattaaccatgcgcacttgcagttaatggaatccttattggatgaagggaagaaaaacaatatttttaagccagatatcgacccattgcaggtgaatattaatattgctgcgcttgggggatattatttgatcaaccagcatacgcttggtctggtttatcacatcagtatggtttcaccgcaggcactggaagccagacgtaaggtcatcaaagagacgatccttagctggcttttggttgacccttcatctaccgcgcgcgaataaaactgccatccggctggcgggtaaacaggacctgttgattattccccgtatcaatggttaagcccgtcaccacgccgctggcgttctggcggattttcaccatctgcccgttttgcaaattactcagtggcttatccgcgccttctacctgcgccatggcatagacatcggtagcgggcagtccgtggtcgcggaacagctgcgccatcgttttaccgggttcgacacgataggagcgccattgattatcaattccgctatctggctggaatggttgcgtatgggtggtttgcggctgctcttctggttggccttcctgtattggttctggagcgaccggagccacctgatcaggatcattttgtggcgtgactaattgcgcccgcagctgttcttctgtcggtggttgtgattgcgactgaatatctaactgcgcttcacgcgtcaccaccggcgcgttgggcgtatcatcagatggaagcagaaatccgaccaccaatacaatggcggcaataatgatcccccgacgatgcatcggcggcagcgggtccatgaagcgaaaattgtccggcgcgtgccagactttctccagggttggttttagttcaaagcgcccgggcatggtttcctcctgctccgcgtcttgttcctcaatcatagcctatgaataagctaacgctatgatgtccgtggtaaacccgcctttattatattcatacgggatattgctattgtttctttttccccgggatttgtcatcattcccgcgacaaagttttacccaaagaagtgtggctgatatgctgcccgctactttataccctaagaaaggaaatacgatgaccaccccaacttttgacaccatcgaagcgcaagcaagctacggcattggtttgcaggtagggcaacaactgagtgaatctggcctggaagggctgctgccagaagcactggttgcaggcattgccgatgcgctggaaggcaaacatccggctgttccggttgatgtggtgcaccgcgcgctgcgtgaaatccacgaacgcgccgatgccgttcgtcgtcagcgtttccagacgatggctgctgaaggtgtgaaatacctggaagaaaacgccaaaaaagaaggtgtaaatagcaccgaatctggcctgcaattccgcgtgatcaaccagggcgaaggcgcaattccggcacgtaccgaccgcgttcgtgttcattacaccggaaaactgatcgacggcaccgtgtttgacagctccgttgctcgcggcgagccagctgaattcccggttaacggcgtgatccctggctggattgaagcactgactctgatgccggtaggttctaaatgggaactgactatcccgcaggaactggcatatggcgagcgtggcgcaggcgcgtccatccctccgttcagcaccctggtgtttgaagtcgaactgctggaaatcctctaagcagcgcattctgttcccctcgaaccagaggggagcaggcattcagcaataaacccttcagtttgccaaacggcgctattttatgttgcaaagaccctgtaagcgtgtatttttgtgagctgtttcgcgttatcaccgtgatatgacactcactttaaacataaaattaacattagatctaaatcttagtattcatcccgcgtattgttacctaatatcgatgagtcccgatacagattcgtcgtatcatagactgactaaaggccgtagagcctgaacaacacagacaggtacaggaagaaaaaaacatggtagatcaggtaaaagtcgttgccgatgatcagtctccggctgaacagtcgctacggcgcaatctcacaaaccgacatattcagcttattgccattggcggtgccattggtacagggttgtttatggggtccggcaaaacgattaaccttgccgggccgtcgatcattttcgtttatatgatcatcggttttatgctctttttcgtgatgcgggcaatgggggaattgctgctttcgaatctggaatacaaatcttttagtgacttcgcttccgatttactcgggccgtgggcaggatatttcaccggctggacttactggttctgctgggttgtaaccggtatggcagatgtggttgccattaccgcctatgcgcaattctggttccctgggctttctgactgggttgcttcgttatccgtgatcattctgttactggttctaaacctcgccacggtaaaaatgttcggtgagatggagttctggtttgcgatgatcaaaatcgtcgccatcgtgtcgctgattgttgtcggcctggtcatggtggcgatgcactttcagtcaccgaccggtgtggaagcatcatttgcacatttgtggaatgacggcggctggttcccgaaaggcttaagcggcttctttgccggattccagatagcggttttcgctttcgtggggattgagctggtaggtacaacagctgcggaaaccaaagatccggagaaatcactgccacgcgcgattaactctattccgatccgtatcattatgttctacgtcttctcgctgattgtgattatgtccgtgacgccgtggagttcggtagtcccggagaaaagcccgttcgttgaactgtttgtgttggtaggtttgcctgcggctgccagcgtgatcaactttgtggtgctgacctctgcggcgtcttccgctaacagcggtgtcttctctaccagccgtatgctgtttggcctggcccaggaaggtgtggcaccgaaagcgttcgctaaactctctaagcgcgcagtacccgcgaaagggctgaccttctcttgtatctgtctgctcggcggcgtggtgatgttgtatgtgaatcccagcgtgattggcgcgttcacgatgattacaaccgtttccgcgattctgtttatgtttgtctggacgattatcctttgctcgtacctggtgtatcgcaaacagcgtcctcatctgcatgagaagtcgatctacaagatgccactcggcaagctgatgtgctgggtatgtatggcgttctttgtgtttgttctggtgttgttgacactggaagatgacacccgccaggcgctgctggttaccccgctgtggtttatcgcgctggggctgggctggctgtttattggtaaaaaacgcatggcgaagtaatgccgcgtttataactctgaaaggcacctgcgggtgcctttgtctttatatattcctaaaaaaatctaccatcatagacagccctcaggcgcgagcttaccgtggatctttgccactcgttgcagagttcattatggttaagcgcagttggttattaatcgccgcattacctctctctatttcaccttcctggggcgcggatttttattaccgccagcaggagaaaggcacggtttatgttgtcgaacagaagggggaaaaagatgagatcctctccgaattaccagatattaatttttcccgcctttggcgcattgccaatttagccaataaacaagattcccggttactgtccgattttcccgataagttcgattgcgatgatgagggggattgcgaacatgtctggctcaccgacggacgctctgttctttggtctggcaaagtcctgaaaaatccccccggtaaacctaaagtcgacgctgccagttttcaggcattcggcgctttcgctgctgataaacgcagtatctattttgacggtcagcgtaccgatgatagatgaagtggatatgtatatagctgtgtctcagttgcaaacaaatatttatgtaccgaaataaaagtatcaatagacaattaattaataaatcaggagataaagtggctatattacatccacaggagtgctggttgctggaaagaataatgtcgccggaatattatcggcgtcgttttgagggctggcaggagtttgtcgagctgtgcgagcgacaggtggcagagtggagcaagaccatgccgctggatgtgcgccgtcgtccgctgtgcgagcagattgacgccgtttggggcgggcgagtgttgcccaatatccgcagtactttaaagtcggtacagtatgactttattcagctacagcagggggacctgcgggtactgcaatccgggggtaacattagcagtgatatgaaaggactaattgattatccgtcggactggatgtcactcgtcgcgcaaaaacagtatgacagactgaaatggcgaggtgcacattataataatttaatcagacgtacctcgggcggatactggtatgacggcgaactgacttattattatgaggaaagtctgcacggcccgctggccttgccgatgcaactaccgttgtatgagctggatagccgcgtatacctgcgtgaggatgacccggtaacgttggctggcttgtatctgccggatatcccagatgccagcgcccaactgttgtaccggagtgaacatattccagaggcttggcaggggcgggtacgaacgaagtatgtcaatgaggctgggatacaagaatattactgggaaaacggggcgtgggaaaaatgcaactggatacgtatacggcgggtggcaaaccgatttatcgatgtgccgccggagggatttttcccacagggcatgccggaggagttgtacaactggccacagcgcgaggcgcagtatgtaacagaccggcagcggatggcggcctgtagcggtgaagcttgtcctcatagcggggagtggtcgatttttgtagaaggtagacaagcgacggtgacactggagcagggagagcagatgccagaatggacggacaggaaaatggagggggagtataaaagaggcgagaaattccatgtgctgtggtcgctgatgaaccgccatgatggcgggtcggtgtgggtggaagcgtagcggtagctggatgtacacgtaaaaaccagggaatgggtgattttattctggcttatacaggagcgatgaataaataattatattaatgaaaaaaataagttagtaaccgttgaaggaactaattattggctgaataatgaattttcccagtccagtagatacaaaagattgtcccggagtggtgaataactcaaagcatttgaaaacgcacctgattgtgtaaaccaggtgcgttggtcgaacaaatcactcacccgccagcgcgcgcgggaatagtatattgttttccagactgatgtgctccatcaggtcatcaatcagttcattaatgccgttatacatcgctttccaggtggtgcaggcttccggcggcggtgtgacgttattggtggtgtgtttgatcacttccagcagttcgcccgcttcatcgtgctcgctttccattacgctgattggccccattgcctggctgcccatgccttgtttaatcatcgggaagagaatttgctcttctttcatcatatggctggaaagctcttcatgcagcatagtcaggtattttgtcagcccttttggcacacttggtttgtcggcgtgaacgcgctcgactttagtcgcttgcaggatcagctccggcagctgctcgcgatggcgatcgtgatagcgcacaataatgtggtcgatgatttccgccagcggcgcgctacgccagtctttctcaatcggttgttcagcaagctttgccagttcggcttcaatgacgtcaacatccagttctttacgtgccgccgcgcgcgccagcgtctgcttaccgccacagcagtaatccatatcatatttacgaaacagagccgaagcgcgaggaatagagagcgccagttcacctaaaggttggtcgcgataagccatagctgatacctcattcttaataatataagatgcattttaaatgcatctttaaggcaaaagctataacccttacgtagcagaggcttatttaactcactgccagcgtgtcaactttctgagacagattcagttaaaggtttttctggttttgctctgaccgcgatgaccacgccaatcactaacagcgcgataccgctcagcgtcattagcggcggcatttgctggcggagtaaaaaggtgtacagcaaacctgccagcgtttcgaaaacaatcagcggcccgagaatcactgtcggtaatcgctggctggcgacgttccagcagagtgcgccaacccatgagcaaagcacggctatcgcaaccatcagactaataaacaccagcggacgggggccaaagggtaaggagaagtccggcgtttgcatattcagccagtaacaggctacgagatagccgatgagagaaaccggcagcgtgaccagcgcctgcgccgtcgcccacatcatcggatgtttgtcgggattttcccgcagccagcgggcgttgcgcagggcataccatgcccagcagaccacggaaactaacgctagcacgatgcctgaggtataacgtgcccagtcaaaatcggggagtccgtggtttaactcagcaatattcacacacgccaggccgatgccaatacaaaccagtgccggggcgagttttccccatgcgagtttgccgtcgcgctggctataaagcagattggcaaaaacgggaatcaccaccggcagggtgccgataatcatcgtggaaacaggcgcgccagtacgttgaatggcactggcaaggcagaagtaatagataaggttgcccatcatggtgagcatcaaggcggtaagccagtcgcgacgcgccaactgacgcagacgcacgcgtcccagccaggcaatgggcagcgcaattaaccctagcgccaggtaacgccccatcgactgcaacatcgccgggtattccggtacgatcaacggcccgacaaaaataagcccccacatcaaccctgctaacagggcgtacagcacgccgctaatcattactggcatccattggtctgtcagaagaaagttcaggaagcagacatgattgctcccggcatcccgtcattatcagagaggatgcgggaggatgccactttaattaactagttattaacattaaaaagatggcttacgctttcggctaacgttgtcgttgggcggccaatcaatttgctaagcgttttgctgtcatcaaacagaccgcctttcgatgcgccaacgtcagaatccgccagcatatccgccagtccatcaggcagtccgacgcttttcagcgccgcagcgaaatcggcttcgctcagattttgataggtaaccgattttccgctctgtttggtgagttctgccgctaactgtgtcagcgtccaggcactatcgcccgccagttcgtaaaccttgccttcgtgaccggcttcgctaatcacgcgtgccgcagctaccgcataatcagcccgcgttgctgaggcaattttgccatcgcccgcggcaccgataaatacgccgtgttccagtgctgccggggcgctggcgaggtagttttcactgtaccagccgttgcgcagcagagtgtaaacgatgccagaatcagccagcattttctccgtctcgatgtgctcatcggcgaggccgagcggggaggaatcggcatgtagcaggctggtataagcgataaatttcacgtcggccgcctttgcggcattaataacattacgatgctgcggggcacgttgacccacttcgctggaagagatcagcagtagtttttccactccctgaagcgcagatgtcagtgcggcttcatcgccgtaatcagcctgacgcacggtaatgccttgtgctgtcagtacctgtgcttttgccggattacgaacgatagccactatttggctggcaggaaccgttttcatcaaggattcaataacatagtgaccaagttggccagtggcaccagtaatagcgatcatgggaagtctccatcgttttgtcttgtgtttaaatacgctaacacttaaacttacttttagtaagtacgtacaaaaaggtaagtatgaaatgagtcaggttagcctgtcgcaacaactcaaagagggaaatctcttcgctgaacagtgtccgtcgcgcgaggttttgaaacacgtcaccagccgttggggggtgttgattctggtggcgctacgcgaaggtactcatcgctttagcgacctgcggcgcaaaatcggcggggtgagtgaaaagatgcttgcgcagtcgttacaggcgctagagcaggatggttttcttaaccgtatcgcgtatccggtggtgccgccgcatgtggaatatagcctcacgccgctgggcgagcaggtgagcgaaaaggttgctgcactggcggactggattgagttgaatttgcccgaggtgttagcggtgcgggatgaacgtgcggcataactgccggatgcgctgcgcttatccggactacggttcatggcttgtagggcggataagatgcgtcagcatcgcatccgccaataaatgccggatgcggttgatgatttgtaggccgaaaaagaagtgttttacttactcagatccacctgataaatcgcaaacccgatatcatcggtcgcgactttattcatcggatactgccctttctctttaataaacgctgcggctttatctgacggagaggtttcgaaacggatatccagtttcttatcgccagctattggtgctaaacgccagttgttatctgccgccgggtgaatttcccccgcacgtttcgactcatcagcaatccacgctgccagcaccgagcggttctcatccggtgaagcaaaagcgatatggctgtcgcccgtaccggcaaatttgccgccgtaagcgcgatagttattggtggcaacgaggaacatggcgttcggatcaatcggcttgccgttaaaggtcaggttcttaatcctttccgcattggcattaatcatctggcactcgccgtcataacgggcgggctgggtaacatcaatctgataattcacaccatcaataacatcaaagttataggtgcggaaaccatcccagttgatgagtgactgtggtttcgtgctgttaggatcaatctggttaaactgtccggcggagcactccagccactctttcacctctttaccgctggctttcaccacaatcagcgtattggggtagagataaagatcggcggcattacggaaggtcaactggcctttttccacctccacatagcttgccgggtcatttttgcgaccaccaactttaaacggtgcggcagctgaaagcactggcagttttgccagatccggatcgccctgaatgtaatgctcgacatacgctttttgcgcgttgttcaccacctgcacggtcggatcgtcctgcacaagcgccagatagctatacatattgtcggcagatttaccgattggcttgctgacgaactggcgtgtggcatcgtgatcggctttgagtgtttctaccagcttgctgtcttccgccgcgagggattttttattcgcgatgtcgtaaatcggccgtgcttccgctttcgcctgcgtcacctgccatttaccgctgtcattactgagttgtaagtcgaccacaccaagatgatcgccccacatgcctggcattaccgccggaacaccattcagcgtgcctttcgcgatatcagccccttcgatatcagcaaaatctttacctgggaaaacggcgtgagcatggccaaacataatggcgttaacgcccggaatttcactgaggtaataaactgagttttccgccatcactttatacggatcggcagacagcccggaatgcgccagaacgacaacgacatcggcacctttctcgcgcatttcaggcacgtatttgcgcacggtttcggtaatatcattcaccgtcactttcccggataaattagctttatcccagcccatgatttgtggcgggacgacgccaatataaccaatcttcagcgtctgtttttttccgtctttatcgaccacttcggtgtctttaattaaatacggtgtaaacattggctgtttggttctggcgtcaatgacgttggcatttacataagggaatttcgctcccgccagcgcatttttcagataatccagaccgtagttaaactcgtggttgccaagcgtgccgacggtatagtccagcgtatttaatgccttatagaccgggtgaatatcacctgcttttaatcctttcgccgacatgtaatctgccagcggactcccctgaatcaaatcgccgttatcgaccagtacgctgtttttcacttcattgcgggcatcgttaatcaggcttgccgtacgtaccagtccgaatttttccgtggcggtgtctttgtaataatcgaaatccatcatgttgctatgcagatcagtggtttccatgatacgcagatcgaccgtcgctgcattcacactggcggcaatcagcgtggctaggagcgttgcgctaaacttaatcatcagggacatccttttatcatcgggaatacgaaagaaaagggagaataaacgtcttacttatagaacagtgaagaatgccacaattttacgctttgaaaatgatgacactatcacagttggcgcattcattaacgatagggtataagtaaaacaataagttaacaccgctcacagagacgaggtggagaaatgttagatcaagtatgccagcttgcacggaatgcaggcgatgccattatgcaggtctacgacgggacgaaaccgatggacgtcgtcagcaaagcggacaattctccggtaacggcagcggatattgccgctcacaccgttatcatggacggtttacgtacgctgacaccggatattccggtcctttctgaagaagatcctcccggttgggaagtccgtcagcactggcagcgttactggctggtagacccgctggatggtactaaagagtttattaaacgtaatggcgaattcaccgttaacattgcgctcatcgaccacggtaaaccgattttaggtgtggtgtatgcgccggtaatgaacgtaatgtacagcgcggcagaaggcaaagcctggaaagaagagtgcggtgtgcgcaagcagattcaggtccgcgatgcgcgcccgccgctggtggtgatcagccgttcccatgcagatgcggagctgaaagagtatctgcaacagcttggcgaacatcagaccacgtccatcggctcttcgctgaaattctgcctggtggcggaaggacaggcgcagctgtacccgcgtttcgggccaacgaatatttgggataccgccgctggtcatgctgtggctgcagctgccggagcgcacgttcacgactggcagggtaaaccgctggattacactccgcgcgagttgttcctgaatccggggttcagagtgtctatttattaattaatttatgcagcaggtccatcacttgctgcacctcttcctgagtaagtgccccgtctttggcccattgcacgcgaccgtctttatccagcaccactacagcggaacttttttcatccagctgccaggcaccgcgtgcgacgccattgctatcaacaataaactgcgaccagggataaagctttttattactctccagactgctgcgcacaaacatccctgaacccggaatcgcgtcgtcggtgttaacaatggtggtggtctggtaacgatcgtgcggtaacttcgctgatttaatcgcttcaatcagcgtcgcgtttttctcttttgcagaggtgcgaccagcaatatgttgcagtactcgcacttttcccactaactgcgcgctgttccaggttttgtagctaaactgatctttatcaagcaccaactcgccacgatcggtgatgccaatcggcggcactcgctgaccggtttcgaactgatgtgcggaagccatcatcggcaacagcaggcaggtgagtgccagaatcttgcgtagggtcatggtgtttccttcttatgatatgcaggtgatccgaccacttgggtctgagttttaatcatatgtgctatttatcgaatttcccgcaagtgtgatgccagtttgcggtcaagcgcacaaatcatatgaaaaatgaatgcttatactgaagaccgcgcttcggtaaaaagataattctgaataattgtaacctttaggtaaaaaaagttatacgcggtggaaacattgcccggatagtctatagtcactaggcattaaaatttgcgcctcataatagttgggccgattgtggcaccgcaaaggcgtaatactcagcaggagataacaatgaaaattttccaacggtacaacccacttcaggtggcgaagtacgtaaagatcctgttccgtggacggttatacatcaaggacgttggcgcttttgaatttgataagggtaagattcttatcccaaaagtgaaggataagctgcatttgtcagtgatgtccgaagttaaccgtcaggttatgcgtctgcaaacagagatggcttaaccaaagtgctatgcagtaaaaagtgctatgcagtaataagacggctcctgatttaggagccgttgatgtttctggggttatgcgacgctttcttctttatctttagcgtcaggcagttttggcgaaagggcggtggctttgctgtcgattcgggtcaccagcagctggtcgatgcggtagttatcgatatccaccacttcaaatttgtagccggcgaatttcaccgaatcggtgcgtttcgggatcttacgcagcataaacatcataaagccgccgatggtttcgtagttgcccgactgcgggaactcgtcaatatccagcacgcgcatgacgtcgtcaataggcgtgccgccgtctatcagccatgagttctcatcacgggcgacaatttgctcttccagcccctggccgaccagatcgcccatcagcgtggtcatcacgtcgttgagggtgatgatccccactaccagcgcgtactcgttcatgatcaccgcgaagtcttcacctgcggttttaaaactttccaacgcctctgaaagggttaacgtatccggcacaatcagcgtgttgcgaatttgtacgccgctgttcagtgccaggctttggttagccagcacgcggttcagcaggtctttagaatcgacatagccgatgatgtggtcaatatcttcattacagacgagaaacttagagtgcggatgttccgcaaccttattcttcagactttgctcatcttcgtggagatcaaaccaaatcacgttttcacgcggtgtcattgaagacggaacggtacgggattccagctcaaagacgttttcaatcagctcgtgttcctgtttacgtaacacgcccgccagcgcaccggcttccactaccgcgtagatatcatcagaagtgatgtcatctttacgtaccattggcagtttgaaaatacggaagattatgttcgccagtccgttgaagaaccacaccagcggggtgcaaacgtacaggcagaagcgcatcgggttgatgatacgcaaagccacagcttctggcgcaatcataccgatgcgtttcggggttaaatccgcaaacaggataaacatgccagtcactaacgagaaagagagaataaagctcagttgctcagagagttctgccgacatatagcgggagaacaggctgtgaaaagctggagaaaatgccgcatcaccgacgataccgccgagaatcgccactgcgttcagaccgatctggaccacggtaaagaacatgccgggattttcctgcatattcaaaacgcgttgggcatttatattgccttcatcagccagcagtttaagtttgattttgcgtgaggcggcaagcgagatctcggacatcgagaagaacgcacttacagcgatcaaacagagtatgactaaaatactgtttaacatatcttatccgacctttcaggccagatcctcggaaggggaagttgattaatttgtgtgaaatacacattgaaagccgattcgaagaaagtgaaccggcattttcagtggctagtatagcgtaaggtactgtaaagccgccagagggttaaaattcagacagctgaaaaatgaaaaactgcctgatgcgctatgccgaacaggcctacgcagtccccgcaatatattgaatttggacgattttgtaggcctggcattttgtttacgccgtatccggcataaacaaaatgcactttatcaacaatctacatttgtacccgtaacgctatgcttccggcggcagacagacgccaattccgccaattccacagtaaccatacgggtttttatgcagatattgctggtggtcatcttcggcataataaaacggtgtggcgttagcgatttccgtggtgatgcgacgatcgtcatcggcggcaagcatcgccgcctgaaaacgttccagactggcgcgagcggcggcatcctgttctggggtcagcggataaatcgctgaacgatactgcgtgccgtggtcattgccctgacgcattccctgggcgggatcgtgattctcccaaaatacttgtagcaactgctcatagctgatgacggatggatcgtaaacaatgcgcaccgcttcggcatggccagtatcgccggagcacacttcccgataagtcggatttggcgtatagccgccggtatagcctgcggcggtgctgtaaacgccgggtaactgccagaacagacgctccacaccccagaaacaacccatcgcaaaaatggcaatctccattccgtcaggtacattggtcattgagtgaccgttgaccgcatgcagtgtggctacgggcatcggggtgttacgtccaggcagggcatcggcgggggaaaccagatgctttttatcaaataaactcatggtgtcgctctcccgaaaatcggtcattggggttaaggttgtaacaagaggcgtatttgcacacaataaccaccgtgaataggtctaaagtaaaacataagaaatattttgggtttagtctgctttttaatccatattactggatttttgttaagccgtttaacggcgttccaggggcaggaaaaaaggatattcaggagaaaatgtgcgctatatccgacagttatgctgtgtaagcttactctgcttaagcggatctgccgtcgccgcgaacgtccgtctacaggtcgaggggttatcgggacagctagaaaagaacgttcgcgcgcagctttctacgattgaaagtgatgaagtgacgccagaccgtcgctttcgcgcacgcgtcgatgatgccatccgcgaaggtctgaaagcgctgggctattaccagccgaccattgaatttgatctccgtccaccgccaaagaaagggcggcaggtattgatcgccaaagtcacgccaggcgtgccggtgttaattggcggcaccgatgtggtattgcgcggcggcgcgcggaccgataaagactatttgaaattgctcgatactcgcccggctattggtacggtactgaaccagggcgattatgaaaatttcaaaaagtccttaaccagcattgcgttgcgtaaaggttatttcgatagcgaatttaccaaagcgcagctgggcattgcgctcggcctgcataaagccttctgggatattgattataacagtggcgaacgttaccgctttgggcatgtgacctttgaaggatcacaaatccgcgatgaatacctgcaaaatctggtgccgtttaaagagggcgatgagtacgaatcgaaagatctggcagaactgaaccgtcgactttctgctaccggctggtttaactcggtggtggtggctccacaatttgataaagcgcgcgaaacgaaagtattaccattgacgggcgtggtttcgccgcgaacagaaaacaccatcgaaaccggcgtcggttactctacggacgtgggaccgcgcgtgaaagcgacgtggaaaaagccgtggatgaactcttacggtcacagtttgaccaccagtaccagtatttccgcgccggaacagatcctcgacttcagctataaaatgccgctgctgaagaatccgctggaacaatattatttggtgcagggcggttttaagcgcactgacctgaacgataccgagtctgactccactacgctggtggcttctcgctactgggatctctccagcggctggcagcgtgccattaacctgcgctggagtttcgaccactttacccagggtgaaattaccaacaccacgatgctgttttatcctggggtgatgattagccgcacgcgttctcgtggtggcctgatgccaacctggggcgactcgcaacgctactctatcgactactccaacacggcctggggctcggatgttgatttctccgttttccaggcgcagaacgtctggatccgcacactgtacgatcgccatcgttttgtgacacgcggcacgctgggctggattgaaacgggtgatttcgacaaagtaccgccggatctgcgtttcttcgccgggggcgatcgcagtattcgcggctacaaatacaaatctatcgccccgaaatacgccaacggtgacctgaaaggggcctcgaagctgataaccggatcgctggaataccagtacaacgtgaccggaaaatggtggggcgcggtgtttgtcgatagcggcgaagcggtaagcgatattcgccgcagcgactttaaaaccggtaccggggtcggcgtgcgctgggaatcgccggtcgggccaatcaaactcgattttgccgtgccggtcgcggataaagacgaacacgggttacagttttacatcggtctggggccagaattatgagtttatggaaaaaaatcagcctcggcgtggttatcgttatcttactgttgctgggatcggtggcgtttctggtgggcaccaccagcggcctgcatctggtatttaaagcggcggatcgctgggtgccaggactggatattggcaaggtcaccggcggctggcgtgatctcaccttgtctgacgttcgttatgagcagccaggcgtggcggtaaaagcgggcaatctgcatctggcggtcgggcttgagtgcctgtggaacagtagcgtttgtattaatgatctggcgctgaaagacattcaggtcaacatcgacagtaaaaaaatgcctccttctgaacaggttgaagaagaggaagatagcggtccgttggatctctccacgccgtatcccattaccctgacacgggtggcgctggacaacgtcaacatcaagattgatgacaccacggtatcggtgatggacttcacctccggcctgaactggcaggagaaaaccctgaccctgaaaccgacatcgctgaaaggcctgttgattgctttgccgaaagtggcggaagcggcacaggaagaagtggtcgaaccgaaaattgaaaatccgcagccggaggaaaagccgctcggcgaaacgctgaaagatctcttttctcgcccggtattgccggaaatgaccgacgtgcatttgccgcttaacctgaacattgaagagtttaagggcgagcagctgcgcgtgacgggcgacacggacatcaccgtgagcaccatgctgctgaaagtgagcagcattgacggcaatactaaactggacgccctggatatcgactccagtcaagggatcgtcaacgccagcggcacggcgcagctgtcagacaactggccggtggatatcaccctcaacagcacactgaacgtggagccgttgaaaggtgaaaaggtgaagctgaaagtgggcggcgcgctgcgcgaacagctggagataggcgttaacctttccggtccggtggatatggatttacgcgcccagacgcgactggcggaagccggattgccgctcaacgtggaagtgaacagcaaacagctttactggccgttcactggtgagaagcagtatcaggcggatgatctgaaactgaaacttaccggcaaaatgaccgattacgcgatctctatgcgcacggctgttaagggccaggagatcccgccagccaccattacccttgatgccaaaggtaatgaacagcaggtcaatctcgacaaacttaccgtcgcggcgctggaagggaaaacggaacttaaggcgttgctcgactggcagcaggccattagttggcgcggtgagctaacgcttaacggcattaacaccgccaaagagatcccggagtggccgtcgaaactcaatggcttgattaaaacccgcggtagcctgtacggcggcacctggcagatggaggtgccagaactgaagctgaccggtaacgtcaaacagaacaaagtgaacgttgacggcacgctgaaaggcaacagttatatgcagtggatgatcccagggctgcatctggaactggggccaaacagtgccgaagtgaaaggcgagctgggggtaaaagatctcaatcttgatgccaccatcaacgcgccggggctggataacgcgctgccggggcttggcggtaccgcgaaagggctggtgaaagtacgcggcacggtggaagcgccacaactactggcagatatcaccgcgcgcggcctgcgctggcaggaactttccgtggcgcaggttcgcgtggaaggcgacattaaatccaccgatcagatcgccgggaaactcgacgtacgcgttgagcaaatttcgcagccggatgtaaatatcaacctcgtcaccctgaatgccaaaggcagtgaaaagcagcacgagctacagttgcggattcagggcgagcctgtctccgggcagcttaatctggcaggaagttttgatcgcaaagaagaacgctggaagggaactcttagcaatacccgcttccagacgccggtcggcccgtggtcgctgacccgcgatattgcgctggattaccgcaataaggagcaaaaaatcagcatcgggccacactgctggcttaacccgaatgcggaactgtgcgtgccgcaaactatcgatgcgggtgccgaagggcgtgcggtggtgaatctcaaccgcttcgacctggccatgctgaaaccatttatgccagaaaccactcaggccagcggtatcttcacgggtaaagcggacgttgcctgggacaccacgaaagaggggctgccgcagggcagtatcaccctttcggggcgtaatgtgcaggtgacgcaaaccgtcaacgatgcggcgctgcccgtggcgtttcagacgctgaatctgacggcggagttgcgtaacaaccgtgccgaattgggctggaccatccgcctgaccaataacggccagtttgatggtcaggtgcaggtgaccgatccgcaaggccgccgtaatcttggtggcaacgtcaatatccgtaacttcaaccttgcgatgataaaccccatctttacccgtggggaaaaagcagcggggatggtgagtgccaacttgcgtctgggtggtgatgtgcaaagcccgcagttgtttggtcagcttcaggttacgggggtggatatcgacggcaactttatgccgtttgatatgcaaccaagccagcttgcggtcaaatttaacggtatgcgctcgacgcttgcaggtaccgtgcggacccagcagggtgaaatctacctgaacggtgatgccgactggagccagattgaaaactggcgggcgcgggtaacagcgaagggcagtaaagtgcgtatcaccgtgccgccgatggtacgaatggatgtatcgccagatgttgtattcgaggttacaccaaacctgtttaccctcgatggtcgcgtggatgttccgtgggcgcgcatcgtggtgcacgatctgccggaaagcgcagtaggcgtttccagcgatgtggtgatgcttaacgataacctgcaaccggaagagccgaaaacggcgtcgattccgattaacagtaacctgactgtccacgttggcaacaatgtgcgcattgacgcctttggcctgaaagcgcggctgacgggcgatctcaacgtcgttcaggacaaacaagggctgggcctgaacgggcagatcaacatccctgaagggcgcttccatgcctatggtcaggatctgattgtgcgtaagggtgagctactgttctctggtccgccagatcaaccgtatcttaatatcgaagctattcgtaacccggatgctacagaagacgacgtcatcgccggagttcgcgtcactggtctggcggacgaaccgaaagcggagattttctctgacccggcgatgtcgcaacaagctgcattgtcttatttgctacgtggacaagggctggagagcgatcagagcgacagtgcggcaatgacctcgatgctgattggcctgggggttgcgcaaagtggccagattgtgggtaaaatcggcgagacgtttggcgtaagcaatttagcgctcgacaccgagggagttggcgactcctcccaggtggtggtcagcggctatgtattgccaggcctgcaagtgaaatacggcgtgggtatatttgactctatagcaacactcacgttacgttatcgcctgatgcctaagctatatctggaagccgtgtctggtgtagaccaggcactggatttgctctatcagttcgagttttagcaatgcgaatatttgtctacggcagtttacgccacaaacaaggcaacagtcactggatgaccaatgcccagttactgggcgatttcagtattgataactaccagttgtatagcctgggccactatccaggcgcagttccggggaacggaacagtacatggtgaagtttatcgtattgacaacgccacgctggccgaacttgatgccttgcgcaccaggggcggtgaatacgcgcgccagttgattcagacgccgtacgggagtgcatggatgtacgtttatcaacgacccgtcgatggattaaagctaattgaaagcggcgactggttagacagggataagtaataataaaagcacgccaccttcgggtggcgttgttttatccaccagtctgaatatattccgaatttgacgccattcttatcttttcttaaatgctgatttgttgcgcagtgttataaacacctggcacgctcaacaaggatgcgaccacaatgaaaaaatctcttctggctgtaatgctgacaggactgtttgctctcgtttctcttcccgctctgggaaatgtcaatctcgaacaattaaagcaaaaagctgaaagtggagaagctaaagcacagttggagctgggatatcgctattttcagggtaatgaaacgacaaaggatctcaccctggcgatggactggtttcgccgtgccgcagagcagggatacaccccggcagaatatgtactggggttacgctatatgaacggtgaaggtgtgccgcaagattatgctcaggcagttatctggtacaaaaaagcggcactgaaggggcttccgcaagcgcagcagaatctgggtgtaatgtaccatgaaggtaatggcgtgaaggttgataaagccgaatctgtgaaatggtttcgcctggcagcagagcaaggtcgtgacagcggccagcaaagtatgggagatgcatattttgaaggcgatggtgtgacgcgggattacgttatggcacgtgagtggtatagcaaagcagcggaacaaggtaacgtctggtcctgtaaccagcttggttatatgtattccagaggtttaggcgttgaaagaaacgatgccatatcggcacaatggtatcgaaaatcagcgacatcaggcgacgagttggggcagcttcatttagccgatatgtactatttcggtatcggtgttactcaggattacactcagtcacgggtattattttcccagtcggcagagcagggaaattctattgcgcagtttcgtctgggatatatattggagcaaggtttagcgggagcgaaagagccgttaaaagcactggagtggtaccgtaaatcggcagaacagggaaattccgatggtcagtattatttggcacatctgtatgataaaggcgcagaaggtgtagcaaaaaatcgagaacaagccatctcctggtacacgaaatcggcagaacagggggatgctaccgcacaggctaatctcggcgctatttacttcagacttggttcagaagaagaacataaaaaggcggtggaatggtttcgcaaggccgccgcaaagggtgagaaagcggcgcaatttaatttgggtaatgctttactccagggaaaaggtgttaaaaaagatgagcaacaggccgcaatctggatgcgaaaagccgcagagcaaggattaagtgcagcgcaggtacaattaggtgaaatctattattatggcttgggcgtagaacgtgattatgtgcaggcctgggcgtggttcgataccgcatcgactaatgatatgaatctttttggtacagaaaaccgcaacattacagagaaaaaactgactaccaaacaactgcaacaggctgaattattatcgcaacaatatatagaaaaatatgccacggaagcctgggcgagaatgcaaaagcttaaagcgcaatcagcggtaaagacgggtaataaataacgggtaactgtcagatcaggtctgcgctaatacagctcaaccaatgccacctgcgggtggcgttatttttttgcgagacgacgcgtattcttttttgtaacttcctcgccttttgcttttccttccgagccgctttccatatccgttaacgcatgtaaaactctgctggcgttaacaaatgtacaggggtaaaacggggacacgctttgaacggtgagtatgagtgaggccggctaacttccagcaagtggctatgaacagcaaaatggtggtcgagtttagcttgttcttaccgttcaagcctttaaactgctgaaaataataatagtggagtagagagtttataaattgcgggcataaaaaaacccctactaaccgaagcccggcgttcagggttattgcgccagaagaacttatttattcttggcgcgctcgaaggaagcaacgatttcagctttagcagcttctgcgttttcccaaccttccactttaacccacttgcctttttcgaggtctttgtagtgctcgaagaagtgagcgatttgcgctttcagcagctctggcagatcgttaacgtctttaatgtgatcgtattctttgctcagcttggtgtgcggaacagcaatcagtttcgcatcttcaccggcttcgtcggtcattttcagtacgccaaccggacggcagcggatcacagaacccggctgcagcgggtacggagtcgggaccagtacgtcaaccgggtcaccgtccagagacagagtgtggttgatgtaaccgtagttgcacggatagaacatcgcggtggacatgaagcggtcaacgaacagtgcgccgctctctttgtcgatttcgtatttgatcggatctgcgttagccgggatctcaataacaacgtagatgtcttccggcagatctttacccgcagggacgttgagtaagctcatgtctgtttcctttaaaaatatgtggcaaacaagtgccgagtattatagccaactcgcgcgccgaatgtcttcgcttgttttcgtcttcattttcctttttcgccagttttaagacggtatacagagcaggaaaatccataaccgtagccgcatttttcatagtgagatgaaagcgattacaaacttgtgattaacgttttatttacttttttgaagtgtgatgtaacgcaatccgttacataacgaattgtctatagttttttcgcgaacatcttttcaccaataataattaccccgacgaggacaaccctatgtggaaacgcttacttgtagtctctgcagtctcggcagccatgtcgtctatggcgttggccgctccattaaccgtaggattttcgcaggtcggatcggaatccggctggcgcgccgcagaaaccaatgtggcgaaaagtgaagccgaaaagcgcggaattacgttgaaaattgccgatggtcagcaaaagcaggaaaaccagattaaagcggtacgttccttcgtcgcgcaaggggtggatgcgatctttatcgctccagtggtagcgaccggttgggagccggtattaaaagaggcgaaagatgccgaaatcccggtcttcttgcttgaccgttccatcgatgtgaaagacaaatctctctatatgaccaccgttactgccgacaacatcctcgaaggcaagttgatcggtgactggctggtaaaagaagtgaatggcaaaccatgcaacgtggtggagctgcagggcaccgttggggccagcgtcgccattgaccgtaagaaaggctttgccgaagccattaagaatgcgccaaatatcaaaattatccgctcgcagtcaggtgacttcacccgcagcaaaggcaaagaagtgatggagagctttatcaaagcggaaaacaacggcaaaaacatctgcatggtttacgcccataacgatgacatggtgattggtgcaattcaggcaattaaagaagcgggcctgaaaccgggcaaagatatcctgacaggctctatcgacggcgtgccggacatctacaaagcgatgattgatggcgaagcgaacgccagcgttgaactgacgccgaatatggcaggtcccgccttcgacgcgctggagaaatacaaaaaagacggcaccatgcctgaaaagctgactctgaccaaatccaccctttacctgcctgataccgcaaaagaagagttagagaagaagaaaaacatggggtattgagggttgctatgcctgatgccgattcgtaggccggataaggcgctcgcgccgcatccggcggttgtgcgctgaagcctgatgcgacgcttaccgcgtcttatcatgcctactgggagcacgctttacaccgggggaaaccatgacgaccgaccaacaccaggaaatcctccgcaccgaaggattaagtaaatttttccccggtgtcaaagcgttagataacgttaatttcagcctgcgccgtggcgaaatcatggcgctgctcggtgaaaacggggcgggaaaatcgacgctaatcaaagcattaaccggtgtataccacgccgatcgcggcactatctggctggaaggccaggctatctcaccgaaaaacaccgcccacgcacaacaactcggcatcggcaccgtctatcaggaagtcaacctgctacccaatatgtcggtcgctgataatctattcataggtcgcgaacccaaacgtttcggccttctacgccgtaaagagatggaaaagcgcgccaccgaactgatggcatcttacggtttctccctcgacgtgcgcgaaccgctcaaccgcttttcagtcgcgatgcagcaaatcgtcgccatttgccgggctatcgatctctccgccaaagtgctgatcctcgatgaacccaccgccagtctcgacactcaggaagtagagttactgtttggcctgatgcgtcagcttcgcgatcgcggcgtcagcctgatcttcgtcactcattttctcgatcaggtttatcaggttagcgatcggatcaccgtcttacgtaacggcagttttgtgggctgtcgggaaacccgcgagctaccgcagatcgaactggtaaaaatgatgctggggcgtgaactggacacccacgcgcttcagcgtgccgggagaacattgctgagcgacaaacctgttgccgcgttcaaaaattacggcaaaaaaggaacgatcgcgccgtttgatctcgaagtacgccccggcgagatcgtcggtctggcaggcttgctgggatcaggacgtaccgaaaccgccgaagtgatcttcggtatcaaacctgctgatagcggcacggcgttgatcaaaggcaaactgcaaacgctacgctcgccacatcaggcttcggttcttggcattggcttctgcccggaagacaggaaaaccgatggcatcatcgctgccgcctcggtgcgggaaaatatcatccttgctctccaggcccagcgcggctggttacgacctatttcccgcaaagagcagcaagagattgccgaacgctttattcgccagcttggcattcgcacaccttccaccgaacaaccgattgaatttctctccggcggcaatcagcaaaaagtgttgctttcacgttggctactgacccgaccgcaatttctgattctcgacgagccaacgcgcggaattgatgttggtgcccacgccgagatcatccgcctgattgaaacgctgtgcgccgatgggctggcgctgctggtgatctcctccgagctggaagagctggtgggttatgccgaccgggtgattatcatgcgcgatcgcaaacaggtaacggagatcccactggcagagctttccgttccggcgatcatgaacgccattgcggcgtaaggagaacagtgtgatgcctcaatctctcccggacactacgccgccgaaaaggcgttttcgctggccaacaggaatgccgcagctggcggcactgttgctggtgctgctggtcgatagcctggtggccccgcatttctggcaggtggtgcttcaggatgggcgtttgttcggtagccctatcgacattcttaaccgtgcggcccccgttgcgctactggcgattggtatgacgctggttatcgccaccggtgggattgatctctccgtaggggcggtgatggctatcgccggagccacaacggctgcgatgacggtcgcgggattcagcctgccaattgttttgttaagcgccctcggcactggcatcctggcgggattgtggaacggcatactggtagcgatcctcaaaattcagccgtttgtcgccaccctgatcctgatggtcgccgggcgcggcgtggcgcaactgatcacctccggacagatcgtcacatttaactcaccggatctctcctggttcggcagtggatcgctattgttcctgccaacaccagtcattattgcggtactgacgcttctcctgttctggctgttgacccgcaaaacggcactggggatgtttatcgaagctgttggtatcaacattcgggcggcaaaaaatgccggggtaaacacgcggatcatcgtcatgctcacctacgtgttgagcgggctatgtgcggcgattgcgggcattatcgtggcggcggatattcgcggtgccgatgccaacaacgccggcttatggctggagctggacgccattcttgcagtggtgattggcggtggtcgcttaagtgcgatgggactactgatgctggcggtggtggttatcggcatattactcgcgcatcgtacccgttttggtaatcaggtatacgccattggcggcaacgcaacgtcggcaaacctgatggggatttccactcgcagcaccactattcgcatttatatgctctccaccggactggcaacgctggcggggattgtcttctcgatttatacccaggccggatatgcactggcgggcgtaggtgtggaactggatgctatcgcctcagtggtaattggcggtacgcttttgagtggtggcgttggaacggtattagggacgctttttggcgtggcgattcagggactgattcagacttacataaactttgatggcacgctgagttcctggtggacgaaaatcgccatcggtattttgttgtttatttttatagcattacagcgtggattaacggtgctgtgggagaatcgtcagagttcgccagtgacaagagtcaacattgcgcagtgataaaaacgcctctccgtgtggagaggcgcaggagcttacgcgtccgggaactcacggataaagcgttcgacatcttcaaccatatggtcgttgccgacaaagaacgaacggcgctggtgcagggtttccgggataatatccagaatacgctctttgccatcgctcgctttaccgcccgcttgttccgccaggaatgccatcgggttgcactcatacagtaaacgtagtttaccgtccgggtggctggcggtgcttgggtagagataaataccgcctttcagcaggttacggtggaaatccgcgaccagtgaaccgatataacgtgaggtatacgggcggttggtggatttatcttcttcctggcagaatttaatgtacttcttcaccccgttcggaaacttaatgtagtttccttcgttgatggagtaggttttgcctttctccgggaagcgcatccgttcctggcacaggcagaaaacacccagcgaaggatcataagtaaaggcgtgaacaccgcatccggtggtgtaaaccagcatagtagaggagccgtataccacgtaacctgccgcaacctgtttgttaccaggctggaggaaatcttcttccgttaccggcgtgccaacaggcgtaacgcggcggtagatggagaaaatggtaccgacagagacgttaacatcgatgttggacgagccatctagtgggtccatcagcaccacgtattttgcgtgttcacagccttcaaagacgacaatctcatcttcttcttcagaggcaatgcccgcaacgatatcgcgtgctttcagtgcggctttcagtttctcattagcgaacaggtcgagtttctgctgaacctcgccctgcacgttctcagcaccgctggcacccaggatatcaaccagtcctgctttgttgatatcgcgatggataatcttggcgcccagttttattgccgacagcaaagcagtgagctcaccggtagcatgagaaaactcgtgctgcttttcgacaataaattcacctaacgttttcataaaactttccctgcaatgtttatggagtaaagcgaccgcaacaatcttaacaaataatcccaatgttgcgctcaggtgaatcgcgccagcaaattacggattatcctgaaatgcgtttctcacttgcccgacatatgcgtaaaatgagcgccagattaaaaaaggatagtgacgtatgcgcattcatattttaggaatttgtggcacgtttatgggcggtctggcgatgctggcgcgccagttaggccatgaagtaacgggttcggacgccaatgtgtatccgccgatgagcaccttacttgagaagcaaggcattgaactgattcagggttacgatgccagccagctcgatccacagccggatctggtgattattggtaacgccatgacccgtggaaatccgtgtgtggaagcggtgctggaaaaaaacatcccttatatgtcaggtccgcagtggctgcacgattttgtgctgcgcgaccgctgggtgctggccgttgccggtacacacggcaaaaccaccacggcgggaatggcgacctggattctggaacagtgtggttacaaaccgggatttgtgatcggcggtgtgccggggaactttgaggtttcggcgcgtctgggcgaaagcgacttctttgttatcgaagcggatgagtacgactgcgccttcttcgacaaacgctctaaatttgtccattactgcccgcgtacgctgatcctcaacaaccttgagttcgatcacgccgatatctttgacgacctgaaagcgatccagaaacagttccaccatctggtgcgtatcgttccggggcaggggcgtattatctggccggaaaacgacatcaacctgaaacaaaccatggcgatgggctgctggagcgagcaggagctggtgggcgagcaggggcactggcaggcgaaaaagctgaccaccgatgcttccgaatgggaagtcttgctggatggcgaaaaagtgggcgaagtgaaatggtcgctggtaggcgaacataatatgcacaatggcctgatggcgattgcagcggctcgccatgttggtgtagcgccggcagatgccgctaacgcgctgggttcgtttattaacgctcgtcgccgtctggagttgcgtggtgaagcgaatggcgtcacggtatatgacgattttgcccatcacccgacggcgattctggcaacgcttgcggcgctgcgtggcaaagttggtggtacggcgcgcattattgccgtgctggaacctcgctcgaataccatgaaaatggggatctgcaaagacgatctggcaccttcattaggtcgtgccgatgaagtcttcctgctgcaaccggcacatattccgtggcaggtggcagaagtggcagaagcctgcgttcagcctgcacactggagcggcgatgtggatacgctggcagatatggtggtgaaaaccgctcagcctggcgaccatattctggtgatgagcaacggcggttttggtgggatccatcagaaactgctggatgggctggcgaagaaagcggaagctgcgcagtaattcacagcctcagcctgatagagtgtgtgtaggccggataaggcgttcacgccgcatccggcatttgagcatagtgcctgatgcgacgcttgatgcgtcttatcaggcctacaggtgcaccgtatccggcaaaccatactcacatcaacaacgaaaattacccttcgttttccgctaactcacgcagatactggaaaatctggcgcgcggatttcggcggcttattcccttctttctctttcttcgcgttgcggatcagagttcgcagttgctgacgatcggcatcgggccacagattcaatacttcagcgatggcgtcatcaccctggtcgatcagacgatcgcgcaggttttccagtttatggaacagcaccacctgctggttgtgacggtttttcagcttatccagcgcctgacggatcggctcaacatcgcgctggcgcagcatcttaccgatgagctgcaactggcggcggcgaccttccatcttaatacgctgggcgagctcaatagccgcgcgcagatccgcatctaacgggatcttatccagcgcgtttttccccagatcaacaatttctgcgcccaggcgttttagctcctcggcatcgcgtttaatttcacttttactgacccagataatttcatcgtcttcgtcttcgatgtcatcaccgggaacgtcgtcgagccagtcttcgggctgcttagtcatctcaggctccttaaaaaaagaggctaatgttaccagttaagatgcgcactgaaaaacggttctctgttagacttcagagaaactctctacattatggcacttgcaatgaaagtaatctctcaagttgaagcgcagcgcaagattctggaagaagcagtttcgactgcgctggagttggcctcaggcaaatcggacggtgcagaagttgccgtcagcaagaccaccggcattagcgtaagcacgcgttatggtgaagtggagaatgttgaattcaatagcgatggcgcgctggggatcaccgtttatcaccagaaccgtaaaggtagcgcatcgtctaccgatttaagcccgcaggccattgcccgcaccgtacaggcggcgctggatattgcccgttacacttcgccagatccgtatgcaggcgtggcagacaaagaactgctggcctttgacgcaccggatctcgacttgttccaccctgcggacgtttctccggatgaagccattgaactggcggcccgtgctgaacaggcggcattacaggcggataaacgcattaccaacaccgaaggcggtagctttaacagccactacggtgtcaaagtttttggcaacagccacggcatgttgcagggttactgctcaacgcgtcattcgctctccagttgtgtaatcgccgaagaaaatggcgatatggagcgtgattacgcctacaccattgggcgtgcgatgagcgatctgcaaacgccagagtgggtcggggccgactgtgctcgccgtaccttatcgcgcctgtcaccgcgtaaactttctaccatgaaagcgccggtgatttttgccaatgaagtggcaacagggttgtttggtcatttggtgggggcgatagcgggtggtgcggtctaccgtaaatcgaccttcttgctggattcgctgggtaaacaaattctgccggactggctgactattgaagaacatccgcatctgctgaaagggctggcatctacaccattcgacagcgaaggtgtgcgcaccgagcgccgcgatatcgtcaaagatggcatcctgactcagtggctgctgaccagctattcggcgcgcaaattggggctgaaaagcaccggacatgcgggcggtattcacaactggcgcattgccggacaaggtctaagcttcgagcagatgctcaaagagatgggcactgggctggtggtgacggaattgatgggccagggcgtgagtgccattaccggtgattattcccgtggtgcagcgggcttctgggtagagaatggcgagattcagtatccggtgagcgaaatcaccatcgctggtaatttaaaagatatgtggcgcaatattgtcaccgtcggtaacgatattgaaacacgcagtaatatacagtgtggttctgtgctgttgccggagatgaaaatcgccgggcagtaaaaaactggcgcgacctgccgcgctataaactaaaaaattacacaaaatcattcgcactgcatcgagacggaaagtgaatgagagcaggggagcgtactcgtagtacgtgactcgggcgaatgagcgtagccgtcgatgaggcagtgtgaaggatgaagtgtaaataaaaaaggaagtgagcaatgcgtaaaagcctgttagctattcttgcagtctcctcattggtattcagttcggcgtcgtttgccgctgatctggaagacaatatggaaaccctcaacgacaatttaaaagtggttgaaaaagccgataacgcggcgcaagtcaaagacgcgttaacgaagatgcgcgctgcggcgctggatgcgcaaaaagcgacgccgccgaagcttgaaggcaaatcaccggacagcccggaaatgaaagacttccgccacggtttcgacattctggtcggtcagattgacgacgcgctgaagctggcaaatgaaggtaaagtaaaagaagcgcaggctgccgcagagcaactgaaaacgacccgcaacgcctatcaccagaagtatcgttaattctttatttccctgttgcctgcactcaggtaacagggaacttatcatcgcaaatgatgcaccacctgattgctgctgccgcgccagatcagggaagggtcttttaaatcctgcacaaatttgccgtcgaccagcacgttaatcaaatcaacaacctgcatttgcgcagcgttgagttcgtcgagtttatagcctgtccacacccagatgtctttacccggacactcggcgcggatgcgttgtaccagtttcagaatatccggcacgttttgcggatgtagcggatcgccgccggagagggaaataccctggcgtttgatacgagtgtcattcagatcgttaatgatctggtcttccattgctttggtaaatggctgaccggaatttacccgccaggtgcttttgttatagcaaccggggcattcatgaacacacccggagacaaacagggtgcagcgagtgccggggccgttgacgatgtcgacaggatagtactgatgatagttcattatttcacctggcttatcagtccgcgtgtaggctgcatccggtaatcaacgcctgatgcgacgctgtcgcgtcttatcaggcctacagccgttgccaaatgtaggccggataaggcgtttacgccgcatccggcatttgcttaacacagagtgaagattaacctatctgcccatttcccaaatgtttaacgcggcgcttaacttcttcctgcttaccagcgttaaacggacgtgcatccgggctacctaaatatccgcacacgcggcgagtcaccgacacacgggaggtgtcatggttaccacatttcggacaagtgaagcctttgctggtgcactcaaattcgccggtaaagccacactcgtagcattcatcgatcggtgtgttggtgccgtaatacggtacatgctgatagctgtaatcccagacatcttccagcgccttcaggttgtgctgaatgtttggatactcgccatagcaaatgaagccaccgttcgccagtggcgggtaaggcgcttcaaagtcgatcttgtcgtacgggttcaccttcttctccacatcgaggtggaaactgttggtgtagtaacctttatcggtcacgcccggcaccacgccaaactcagcggtatcgagacggcagaagcggtcgcacaggttctcactcggtgtactgtagaggctgaaaccgtagccagtttcttctttccactgatccaccgcctgacgcagacgctcaacaatcgcaatacctttcgcgcgcagctgctcgttgtcgtaaacatgctcgccgccgaacagcgcgttaatggtttcgtggatgccgatgtaacccagcgaaatagacgcacgaccgtttttgaagatttcagaaacgtcgtcgtcagcattcagacgcacgccacaagcgccttccatatagaggatcggggctacgcgcgctttcacgccttcgagacgagcgatacgggtcatcagcgccttacgtgccaacaccagacgttcatccagcagcttccagaaggtggcttcatcgccttttgcttccagagcaatacgcggcaggttcaggctgatcacgccgaggttgttacgaccatcgtggatctgctcgccgttttcattttcccacacgccgaggaagctgcggcagcccatcgaggttttaaacgaaccggtgactttcactacctgatcgtagttaaggatatccggatacatgcgcttgcttgcgcactccagcgccagctgtttgatgtcgtagttcggatcgccttttttatggttcaggccatcgcgaatcgcaaacaccagtttcgggaacaccgccgttttacggtttttaccgaggccggcgatacggttacgcaggatagattcctgaatcaggcgcgactcccagctggtgcccagaccaaaaccaaaggtcacaaacggtgtttgaccgttggcggtgtgcagggtgtttacttcgtactccagcgactggaaggcatcgtagcactctttgatggtacgagagttagcgtagccttcggcgtccgggatgttccactcttctgcggtcttgcgatgtttgttgtagctggcggtgacaaacggtgccagcacttcatcgatacggttaatggtggtgccgccataaatatggctggcgacctgagcaataatctgcgcagttaccgcggttgccgtagagatcgatttcggcggttcaatctcggcgttccccattttaaagccctgggtcagcatgcctttcaggtcgatcaacatgcagttgaacatcgggaagaacggtgagtaatcgagatcgtgatagtgaatatcaccacgttcatgtgcctgcaccacgtcacgcggcagcaggtgctggcgtgcatagtgtttagccacgatcccggccagcaggtcgcgctgggttggaatcaccttgctgtctttgttggcgttttcgttgagtaacgaggagttggtctgctcgaccagaccacggatctcctggttcaggcgaccgcgtttttcacgttcaatgtcgcgatcgtgacggtactcgatgtaagcacgagccagttgtttgtatggccccgacatcagctggttttcaactgcggtctggatctcattgatatccacctggttgcggccctgcatctgctcgctgacaaccgcagcaacagtggcgcaataatcggcatcatcgacttccgctgctttagctgcacgcagaatcgcttctttgatgcgctctgatttaaacggcactttgcagccgtctcgtttcatcacatgcggtgtcatgatcgctccatatttttaagaacaggttatccacagaaattgggaaaggcgttttccggttttttcgtttcgttttccggtgctttccgcaatcgccatccgcttatccacaacgccgcacctttttcgtggggagctgtagtagcaattatagtcgattaatacaacatattgggttgggacgcattttaaagtctatatatagtgctttgcatcaaggatgtttgaactttttttgatgtagctcaaagtaaaaagcagagcgtacggatgacgggcgctacagcgttatgtaaattttttaatgaatttgctggttgaaaaatcaacaaaaacaacatgctgacagacaaaaccccggaatgaccggcattaccggggcttagcgaagatttacttttgtaacaaccagacagcctcaaaaggccgtaaagtcatggcgcagggttgtggtgaggcttcttcgtagttatgcatcacaagctgccagttgccgcgcatttgccctggttgccagggttggatctcacggctaaggttggcaatgaccagcaaggtttgccccttccattcacggcgatagcaccacaatacagggctgtttggcagcagatcctggtaatcgccccatgtcaggacggcttcttgcttacgcagtgcgattaacttttggtaggtgtaaaacaccgaggactcatcggccagcgctgcttctacgttgatttcctgatagttatcgcccaggccaatccacggttcgccagccgtaaacccggcattatcgccgttggtccattgcatgggtgtgcgactgttgtcacgggatttactggcgaggattgtcaataactcgtcggcatcacgcccatcgttgcgcagctcggcaaacatattgaggctctccacgtcgcgatagtcagtaatgcgcgtgaaatgtgggttggtcatgccaatctcttcgccctggtagatatacggcgttccctgcatgccatgcagcaccatcgccagcatttttgccgcaggcacgcggtattcaccttcatcaccaaagcgagaaacaatgcgcggctgatcgtggttacaccagaacaaggcattccatgccacgttgtgcattccttgttgccagtggcggaacaatgttttcaacgccacaaagtcaggtttagccagcgtccatttttcaccaccgggataatcgaccttcaggtgatgaaaattaaaggtcatcgacaattcactgcctgtcagtgccgcgtatcgctggcaatgctcaaggctggtggaggacatttcacctacggtcattaacccgcgtggcgtaaacacatcgcggttcatctcgtgcaaaaactcgtgtgctcgtggcccgtcggtatagaagcgacgcccatcgccatccaggtcttcagggtaacgcgggtctttggagatcagattcaccacatccaggcgcaacccgtcgaccccacgatcggcccagaactcacagacttttttcagctctgcgcgtaccgctggattctcccagttgagatccgcctgttctggtgcaaagagatgcaaatagtactgttcgctttctgcatgccagcgccacgcactaccaccgaattttgaacgccagttgttcggtggcgtttctggttctccatcgcgccagatataaaactggcggtaagggctttctttgttcagcgcctcgcgaaaccaggcatgttgggtagaggtatggttaaacaccatatcgagaatgatacgaatcccacgcgattttgcctgtgtcaccagttcgtcaaaatcgtccagcgtgccataggtgggatcaatcgccgtataattcgctacgtcgtaaccgttatcgacctggggagagacataaaagggggttagccagatggcatcaacgcccagtttatgcagatagtccaggcgttggataacgccacgtaaatcgccggtgccgctacccgtggtgtcctgaaaactctttggataaatctggtagataacgccgttttgccaccagtggggaagatgagtcattacgttattcctgcaaatgcgagggggcgcaattgcgccccgaagaaaattaaacaatgtccagcgtgcccaggcggtatttccgctgatagataaacgaggtgagtacaatcgggatgatgatggcgatagccattgccagcgcaaacacctgccagtagctcggctgaatggagaggatgcccggcaggccgcctacgccgatgccattcgccataacgccgttcaggccgcatagcaatcctgccagaccagaaccaatcatcgcgcacagcatcgggaagcgatatttcaggttgatgccgtacatagcaggctcagtgactccaagccaggcggagatagcggcaggcacggagatctcgcgttcattgtgcttgcggctggaaatgataatacctatcacggcggagccctgagcaatattcgacagcgcaatcagcggccacactggcgtgccacccatgctttgaatcatctgcaaatcaatagcaagcgtggtctggtgtacgccggtgatcaccagcggggcgtacaggaagccaaacaatgccgcgccaatcggagcaaagctgccggtcatcaggtgacgtaccgcaaaggcaacgccatcgccaatcatgcgaccaaacggaccaatcagcgcatgggcgaggaacaccgcgaggatcagcgaacagacgggcaccaccaccagatagaggtaatccggcacgatgcgcttaagacgagtttcaataacgcccagcgccagtccggctaacagtgccgggatgacctgcgcctgatagcccactttggcgatgctgaacatgccaaagtcccatacttccggcagctgctgcccgagcagataagcgttcatcagctgtggagaaaccagcgttacgccaagcacgataccgaggatcggtgtaccgcccatttttttcaccgctgaccagcaaatcccgaccggcaggtagaagaagatcgcttcaccgatcaaccacagaaaatcgtagatcgtttgcagggaagggtacatttgcgccagcgtctgaccgttgctcatgggcaaatcgccgatcacattgcgaaaaccgaggatcaaaccaccactaatcaacgcgggcagcaacgggaagaagatctccgcgaaatgagagatcaactgctcatgccatttcatattctgccgggcggctttttttacctgctctttatcaacctgcgcctgtccggttgacgcaatcagtgcttgatagtaatcacccacgttggtgccaatcaccacctgaaattgcccggcattggtgaaacagcctttcaccatggggagttgctcaatttctttcggtctggcattggccggttggttgaggacaaagcgcaggcgagtaatacagtggctcaccgtcgcaatattgccgcgcccgccgaccagttcaatcaaccgatcgatatccgtttggtttattttgctcatcataaagccccatggcagatgacatttttggttggctgcagaatatattgcgcggaaaaatttaaaaacgggaacgttcccgaaacgcagcgaagatcacaatttatcgttcaggaaacgatcaggacagggtggcggggatgatgatttgttgcggttcgctgcgcccggttacctgcgcgatcaactggcaggccgcctggcgtccagcttcggcataaccgggatctacggtgacgatctccggatggaggaatttcattaacggtgtattaccgacgctcgccagttgcaaggtgtcgatgcgttgctcttgcaggtatttacttgcgccaagtgccagcgtgtcggttgcgcacagtaacgcggtagtttcaggcgtaatcacttttgctacgttctcatagccttgcttcatagcaagccctggcagagcggcaacgggatgcaatttatgcgttttgcagaacgcaaggtaggcttcgtgacgtcgcttaccggttgtcacgtcactgtgcggcacgccgagatagctgatattacgatgtccctggccatacagccgttgcatcaggatcttgattgccccttcgtcgtcataacagaccgaagcaaagccttttgcgtcacgcgccagcagaaccagcgatgactgccagtgggctaacatttcttctgttatgccggtaaaaccgaacagcactacgccgtcgatattacgccgtttcagcacccccaaatgttcggcaactaattgtggggaaaactgactttccatcatgattggatcgtaaccttgttcatagaacgctggcagcatggtttgaacggcgagattttctgacaacgaatccagacgggtaacaatgatggcgaccactttatcgctttgcccacgcatagcgcgcgcagagcgggaaggggaaaatccatgctgattcatcactgcttcaacacgctcgcgcgtgcgctggctcacgccgctttcgttattcagcacccgggaaaccgtagatttccccacgccgcttaagcgcgcgatgtctttgatggtcagccgattttgcatcctgttgtcccataacgtgttgtttaattatttgagcctaactttacctgtgcattcagcaatgggtaaagtctggtttatcgttggtttagttgccagcaggtattatatcgccataaatgctacgaatattattggattctccttattatttgcggcgcttttttcacttaccggaggttatatggaacctgatcccacgcctctccctcgacggagattaaaacttttccggtaagcccgtcttttcacggcgttaccggatgcgtaaggccgtgacgttttaacgtccctgctcagctttattaccttcaggtaaggcttcgccacgcctgaagacatttctgtactgtttcagacagtgcggagggactccttatgtttaaagaaatttttacccggttcattcgccatttaccttcccgtctggttcatcgtgatccattgcctggcgcgcagcagacagtgaatgcggcggtcccgccttctttaagtgcgcattgcctgaaaatggcggtgatgcccgaagaagaattgtggaaaacgttcgacacccatccggaagggttaaatctggcggaagtggaatctgcccgcgaacaacatggtgaaaataaattacccgcacaacaaccgtcgccgtggtgggtacatttatgggtctgctatcgcaacccctttaatattttgcttaccattctcggtgctatttcttacgccacggaagatttatttgccgcaggtgttatcgcgctaatggtcgctatttctacgttgctgaactttattcaggaagcacgttccactaaagcggcagatgccctgaaagcgatggtcagcaatactgcgacggtgctgcgcgtaattaacgacaaaggcgaaaatggctggctggagatcccgatcgaccagctggtgcccggcgatattataaaactggcggcgggggatatgatcccggcagatttacgtatcttgcaggcgcgggatctgtttgtcgctcaggcgtcgttaaccggtgagtctctgcccgtagaaaaagccgctaccactcgccagccggagcacagcaatccgctggagtgcgacaccctgtgttttatgggcaccaccgtggtgagcggcacggcacaagcaatggtgattgccacaggtgccaatacctggtttggtcaactggcgggtcgtgttagtgagcaggaaagcgagccgaatgcctttcagcaagggattagccgcgtcagtatgctgctgattcgctttatgctggtgatggctccggtggtgttgcttatcaacggttacaccaaaggtgactggtgggaagcggcactgtttgcgctttcggtcgcggtaggcttaacgccggaaatgttgccgatgattgttacctcgacgctggcgcgcggtgcagtaaagttgtcgaaacagaaagtgatcgtcaaacatctggatgccattcagaactttggcgcaatggatattctgtgcactgataaaaccggcaccctgacacaggataaaattgtgctggagaatcataccgatatctccggtaaaactagcgaacgcgtgctgcatagcgcgtggttgaacagccattaccagaccgggcttaaaaacctgcttgatacagcggtgctcgaaggtacggatgaagagtcagcgcgctcgctggccagccgttggcaaaaaattgatgagattccgtttgatttcgagcgtcgtcggatgtcggtggttgtggcagaaaataccgaacaccatcagttggtttgcaaaggcgcattgcaggaaatcctcaatgtgtgttcgcaagtgcgtcacaatggcgagattgtaccgctcgatgacaccatgctgcgtaagattaagcgggttactgatacgctgaatcgtcaggggctgcgcgtggttgcggtggcgacgaaatatctgccagcgcgtgaaggagattaccagcgggcggatgaatccgacctgatcctcgaaggatatattgctttccttgatccgccaaaagagacaacagctccggcactgaaggcattaaaagcgagtggaattaccgtaaaaatccttactggcgacagtgagttggttgcagcgaaagtgtgccatgaagtggggctggacgcgggagaggtggtcattggtagtgatattgaaacgctatctgacgacgaactggcaaatctcgcacagcgcaccacgctgtttgctcgtctgacgccgatgcataaagaacgcatcgtaacgttgctgaagcgcgaagggcatgtggttggctttatgggcgatggtattaatgatgcgcccgccttacgcgctgcggatatcggcatttctgtggacggcgcggtagatattgcccgtgaagcggctgatatcatcctgctggaaaaaagcctgatggtgctggaagagggggttattgagggacgtcgcactttcgccaacatgctgaaatacatcaaaatgacggcgagctctaacttcggtaatgtgttcagcgtgctggtggcgagtgctttcttgcccttcctgccgatgttgccgctacacttgcttattcaaaatctgctgtacgatgtgtcacaggtggcgatcccatttgataacgtcgacgacgagcaaattcaaaagccgcagcgttggaatccggcggatctggggcgctttatggtcttcttcggaccgatcagctcgattttcgatattctgacgttttgcctgatgtggtgggtattccatgccaacacgccggaaacgcaaacgctgttccagtcgggctggtttgtggtgggcttactgtcgcaaacgctgattgtgcatatgatccgcacccgccgtgtgccgtttattcagagctgtgcatcgtggccgttaatgatcatgaccgtgatcgtgatgattgtcgggatcgcattgccgttttcaccgctggccagttatctgcaactgcaggcgctgccgttaagctatttcccgtggctggttgcgattctggcagggtatatgacgttaacccagttggtgaaaggtttctatagccgtcgttacggttggcagtaaagaataaactgggcatggtggcccggaatcagattgcagacaaagtgagctttgttcatgccggatgcggcgtaaccgcctaatccggtctacaaattcaataaattgcaggaatcacgtaggcctgataagcgtagcgcatcaggcgattttgcttttgtcatcagacttaatccgggcatgatagcccggatttccatcaagattagcgacgaacagcgatcgcttcgatctcaatcttcacgtctttcggcagacgggctacttcaacgcaagaacgtgccgggaaggtggcgttgtgttcggtgaagaaggcttcgtaggtagcattaacggttgcgaagtcgttcagatctttcacaaacacggtagttttaacgatgtcgcccactttcaggccagcggcttcgacgatcgcttttacgttatccagcgactgacgcgcctgtgcagcgacgtctgccgggacttcgcccgttttcggatttaccgggatctgaccggaggtgatgatcatattgcccagatcaacgccctgtacgtaaggaccgatagctgccggtgcattttccgtcgcgatagttttgctcatgatttctcctttattacagcggtaaaaagtctggctcattatagggagccagacttttattaccaaccgcaattaattggccagcaccacattatgagaaaactctttttcacagtatttgcatttgagcgcgatatcattggcgcgttttcgcacggcaaagctggatgaaaccggttcggcatggctgatacagttgctgttagggcagaccagcacattgtcgatgcgctctggcaaactggggcgcgatttgccaaccacttcatagttgtcgatacggttaaccgtggcttgcggtgcatataacgccagctgatcaacctgatcctcacttaaaaaggtattttcgattttgatcaaatctttgcggcccatctcgccagaaggcaaattcagaccaatggtgatgcgctgatctgtttcggtcaacttgaacagactcaacagcttaaaaccgatctgggcggggatatggtcaattaccgtgccgcgtttaatagcttcaacctgcaatttattatcgtgtgtcatctctatttccccttacagtaccagatcgcgattcagaaccagtgccagtaacgcctggcgagcgaaaatcccgttgcctgcttgctggaagtaccaggcgtgaggcgttttatccacatccgtcgcaatctcatcaacacgcggcagcggatgcagcactttcatattggctttggcgttgtggagatcgctggcgcgaagaacaaactgcgctttcacgttggcgtactcggacgggtccagacgctctttttgcacgcgggtcatgtacaggatgtctacttccgccatcacttcttcaatagaactgtgcagactccaggcgatccctttttcatcgagcatatccagaatgtattgcggcattgccagcgcatccggcgcgataaagtaaaaacggttgccgtcgaacttcgctagcgcctgggtcagggagtgaacggtgcggccatatttcaggtcaccaaccattgcgacgtggagattgtccagacgcccctgggtttcctgaatggtgaataagtccagcaaggtttgcgtcggatgttggttggagccatcaccggcattcagtaccggtacattgccggaaaactcggtggccaggcgcgctgcaccttcctgcggatgacgcatcactatcgcatcgacgtaagtgctgataaccgaaatggtatcggccagcgtttcgccctttttacccagtgatgtattggcgctgtcggagaagcccaccacgctggcacccaggcggtgcatggaagtttcgaaagagaggcgggtgcgggtagaggcttcgaagaaacagctggcaataactttgtgcttcaacagctctggttgcgggttcgctttcagtttcgccgctgtcgccagcaccagattaaggtcatcgcgactaaggtcgtttatggaaatgatatgtttctgatatagcggattagccatcttttatctcctgacgcctgggcaaaaaaaagcccctcgattgaggggctgggaatgggtgatcaacgggaagaaaaacggcaggccagcgtcttttttcagacgcggtaagacaaaatgtcgaacacactgaaccatacatcctcccggcaaattgtccggcattatactcagctctgagagaggatcaagaagatgatgcagttataaagcaaggcaaacggttatcatgaatatatattcaattttaataagtaattaatttgcttgtgcaccagggctgtgcgctttaccacacgtggtgcgacccaaacgatattgctgccagcaatcacgccaagaatttctggcaaagcatggaaatcaaggattcgtgctactgcccgaccatatccggcgacggtatggataaggataaattcaccattatgctcgacactcaggaccatttcagcgacggatcgacctgcgtcaggtgtgggaagtaattgaggattcaccgaataaattttttgtccttttgtatttctaatttttatgactcccagcaatttcagtagtcgtgaaacggttgactgactgatactgtcaaagccatggttttgcaaatcgcggcggatttcctcctgtgaaagataacttttttcggtaatcaggcgctgacagaccgccagttgcttcttttctttggcggagtaatcatcgtattccttcataatgcaccttttatttattattacctgatgatatttttcacattttataatgtgagagtggttcatttatcactacaccagatttgaaggccgctttgataagcggcctgtcgcgttaaatcatcgcggcgatactcagcacaatcatattcaacatcgtgagaatcagcagtagcggtgctacccatctcagataacggacccagggtacacgggcaatcgccagaccgcccatcactaccgcagaggttggcgtaatcaaattaaccaccccggaagcagactgataagcggtcaccaccagatcgcgttgtacatgagcaaaatcagcgagtggagccaatattggcatcgttaacactgcaaggccggaagatgagggaaccagaaaagagagcaatacttccagccaataggtcacgttgatgaaaacagtggtggaaagccctgaaaccagattctcagcactgtgcagaattgtgtgcgtaatcatgccgttatccatcacgaccacaataccgcgggcgatgccgataatcagtgccacaccaaggagatcccgcgcgccgtcaataaaggtactggtgaaggtttcttcgcccatgcgggcaatgacacccacgatgaccgcagctgccagaaagacagcagagatttccgccatccaccaacccagtaccgctacgccgtaaatcataaaggcaaaggatgcagcaaaaagtatcaggatcgctttgcgcgtgggggtaaattccagcatcgtttctgaacgatttcccagaaaatgcgcctggttttcagccatcttatccgccacgatagagctttccggactgttgcgaactttgcgggcataacgcataacccagtaaacacaaatcacgtagcctactaacagcaaaataacacgcagcaaaatgccctgagtaaaggggatccctgcggcgttggcagcaatgacggtagcaaatgggttaatggttgagcccagcgtgccaatgcccgctcccaataacactgtggcggcagcgaccagaggatcaaagcgggcagccatcatgacgggcaccagcaacgtgtagaaggggagtgattcttcagccatcccataaatagtaccgccagcagcgaagagcgccatcaggatcggaatcatccactcttcccgaccattaaggcgagttgtcactcgttcgataccggcatctattgctccggttttatttactactcccaaaaatccaccgatgatcaggacaaacagcgcgacatcaatcgctcccgcagtgtaggtttgatggttgtacaagccgtcgatgggcgctaacaggacagccgtaataccctgtggttgcgcctcaacaggtgcgtaagtgcctgcaacaggaacttcctttcccagtgcggcatttgtcaccatctgatattttcccgcaggtacaatccaggtcattgccgcaactaacgcaatcagcacgaacaagatggtataagcggtgggaaatttgaatttacccataatgtgatctccataatcacgggcatacgccactcgtcgacgcatgcccgtcagggttagtcgccgagagttgctaccatcaccgctttaatggtgtgcatccggttttctgcttcatcgaaaacaatggagtgggcagattcaaaaacctcatcagttacttccagtcctttgaggccgtaggccatctcgatctcgcgtcctactgtggtgtgctcattatggaaggcgggcaggcagtgcataaatttgacttcagggttacgcgtggcagtaatcacctgttgattgatctgataaggtgtcataagactcactcgttctgcccaggcttcttttggctctcccatcgaaacccaaacatccgtatagagaaaatccacgtcgtatacgccttcttccacattctctgtcagggtgattctcgccccagtcacgctggcgatctcacggcattgtgttaccagcgcttcatctggccagaaagatttcggtgccaccagacggatatccatccccatttttgcagcaccaaccatcagcgagttccccatgttatttcgggcatcaccaagatacgcaaagctcagctctggcagcgttttgcctggcgcatgttccagcatggtcattaaatccgcgaggatctgtgtcgggtgaaattcattggtcagtccgttccataccggaacaccagcgaactcacctaattcttcaacgatattctgaccataaccgcgatactcaataccgtcatacatgcgtccgagtacacgagcggtatctttcattgattctttatggccgatttgtgagccgctggggccgatgtaagtcacctgcgcaccttgatcaaaggccgcgacttcaaaggcacagcgggtacgggtagaggatttttcaaaaatcaacgcaatgtttttaccgaccagcgtttgtttttcgtttccagatttcttggcggctttaagattgatagccaaatcaatcaggtattgaatctctgctggggtgtaatcaagcagcttaagaaaattacggtttttcagtgaagtagccatggggatgtccttataaaaatggatcaagcgtggttatggggggtatcaaggcgaataagagtgcctttgtctccggcgagaatttccggaccatctgcaagagagccgatccctgcaatgccccggcactgactaacaaactttgcgcaggcggtgactttcggccccatagacccggcatcaaactgcatttcgttgagtaattccggcgtgacctgggccagcgggcgttgggttggcttgccccagtcgagatatactgcgtccgcatcagtgaggatcaacaaggcgtcagcatggatctgacttgccagtagcgcggctgaaagatctttgtcgataaccgcttcaatcccatggtatccatcggctttttcaaccaccggaacaccaccgccaccattacagatcaccagatgatcgtgggcgatcagtgtctggatggcatcccgctcgacgatgcgtttaggttgtggagaaggtacgacccggcggaaagagtgaccatctgctttgaaaacccagcctttttctgcctgtagtacctgagtctgagcgtggtcataaattgggccgatgtacttagttgggttactgaaggcgggatcgttggcatccacttcaacctgcgtcagcagcacgctgatttcacgttgtggtagttgatttttcagcgcctgttgtagcatgtagccgatcatcccctggctttcggcccccagaatgtcgagtggatagggagcgacatgggcataggcgctattttgaagtgccagaagtccaacttgtgggccattcccgtgaaccagtacaacccgccagtgttgagtcagttgggcgatagttttagccgcaagatcgatatttttacgttggatttctgcttcgagtggttcgcctcgtttaagcagggcattaccgccgagagcgataaccagtgttggtttgttttccatgatctcttccttagataccgtcacgatgcaaagggcaactcatgcaacgtgcgccgccacgtccgcggcctaattcatcaccggggatgggtaaaacggtgatgcctgctttgtcatatttttcgttagtccagatgttgcgctcgtagcccactaccactcccggccgaagcgtgagcacattgttagcgtcattccactgttcgcgttctgcctcaaaggcatcaccccccgtggtgattaaacgtacctggtcaataccgagggctttttcgatagcatggaggagtgtgctttcttgagtacgtttcaggccgccgtgaccgtcaggtgttagcgtccagcaattaacatccgggcgcacaacttcgggataaaccgagaaggtgtcgatatcgatatgagtcataacggtgtcaagatgcatacaggagcggtgtttaggcagctcaacagcgattacccgttcagcctgacgatgtttaaacaatgcctgagcaagaaactcgactccttgtggcgtggtgcgttcagacatgccgatcaacacggccccccgaccaatcaccagcacatcaccaccttctaacgtggcgtggtcataattaatattctcgtcgccgaaatatttaataaattcgccgccagcaaattgtggatgccagcgataaatagcgcgtagattattggtttcacgttggcgagcaggttttgccattggattaatcgatacaccgttataaatccagcatgaggtatcacgcgtaaataaatgatttggtaacggcttcataatgaaatcattaatatcgtgggtatcaaccaccatatttttaattgaggcgggaatttcactataagtcagcccaccacttaaatgacgagcaaggtcccggtgtgacatctctgcaagccaggtgcgaacgtcagtagcaaacgtagggccgagtcggtaatctgatatttgtgtttccagtaaccagcttttggcttccgggatatccaatgtttgtgttagtaaatcagtgagtaacagaacttctatcccttgctggcgcagcgtattggcgaaaatatcatgctcttcacctgcccgctcaacggacaatacatcgtcaaataacaactcctggcaattggatggtgttagacgtttcagactgagatttgggcgatgcaacataacgctgcgtagttgtccaatttcagaaccaacataatgcttttccatcattattcctttaacactttttcaaaaataaagaggagatggctgcaaacaaattaaatgcttgtagtcaggtctgttcagtaattttcagatgcaatgattcagtttatttcttccagaaaatgtgacgactttcacaccggcggtgatattaataatcgaagttaataatatttgatgcggttctgataaatgataaagaaacaaaatacgataatgcattaatacgcaaatatacgcagagttattcttcgttgttaattgattgttttatttttcaggaaatgcctttaagtataatacattgatatttatgtatattttaatattcattgcatatctatgcgaaaggataaggtgattatttttcacagcactattttcacgggataactatgacagcacgggcattaaaagctaagaaaatgaactgtgatctgactgagagttttcttttaacatatgcaataacaagatattaggaccaaaatacatagctaagttataagatttatgcagcaaaactgcatacaaaattactcctgcttaacatcagtacaacatctccagcaataaacatgcgcaagggcaaaacctgatgatttttctatggtgagaggtggttttttttcgtataaggaaagaagtgaaacattgttttaataaaggaagatattatgattgttggcaacatccatcacttacaatcctggctgccggaagaacttcgcgaagcaattgagtacatcaaatcacatgtcagcgatgagacagcaaaaggtaagcacgctattgacggcgaccgtctgttttatctgatttctgaggatacgactgaaccaggtgaactgcgtcgtgctgagtatcatgctcgttatctcgatatccagattgtattaaaagggcaggaagggatgacatttagcacgcaaccagcaggcgtaccagagactgactggctggcagataaagatattgcttttatcgggcaggggatcgatgaaaaaacagtgattcttaatgaaggggattttgtcgttttctatcctggcgaagttcacaaaccgctttgtgcggtgggagcccccgctcaggtacggaaagcagtagttaagctattaaaatcgtaagtgatcactgccgggggcgacctgtgccgccgcccggcaaaacgttattttgctaatgtagcgaccataacagcttttatggtgtgcatccggttttctgcctggtcaaagacaatacttgccggagattcaaagacttcatcggtgacttccattccaccatacagaccgaattctgcggccatttttttacccagcgtggtttgctcatcatgaaatgcaggcagacagtggaggaacttaacctgcgaattaccggtcagggctatcattttgctattcacctgatagtcacgcagcagggcaatacgctccgcccatttctctttgggctcacccatcgatacccagacatcggtatagataaagtctgcgcctttaaccccagaggcgatatcttccgtcaaggtgattttacccccgtgtttttgtgccagagcactgcattcggcgaccagcgcagcttccggccagcatgcctgtggcgcgaccagacgcaaatccagaccggtaagcgccgcagcttcgagcatcgaattgcccatgttgttacgcgcgtcacctgcatagaccagcgtcatttcgttgaatgctttgccgggcaaatgctcctgcatggtgaggagatccgccagcagctgcgtggggtggaactcattggtcaggccgttccatactggcacgccagcgtattccgccagtgtttcgacaatctcctgaccatagccgcgatactgaataccgtcatacatgcgaccaagcacgcgggcagtgtctttaatcgactctttgtgaccaatctggctgccgcttgggccgagataagtaacgcgagcaccctggtcatatgcggcaacttcgaaagagcatcgggtacgggtcgagtctttttcgaagatgagcgcgatgtttttgccagtgagtctggcttcttctttaccgcttttcttatcggctttcagcttcgcggctaactgcaacaagctgttgagttcagctggcgtgaaatcgagtaatttcaggaaatgcttatgataaaacccggacatagatccctcctgtggctaacgcctcaatgaattaaaattcaatttatatggatgattattcatttgcaagtctaaagcataaatctttgtcacaaaggtggaggcaatgtcagtggtgtgtgacaataagagtatcggcaggacattaagaggaataagccatggcaaacccggaacaactggaagaacagcgtgaagaaacacgtttgattattgaagaattactggaagatggcagcgatccggacgcgctgtacaccatcgaacaccatctttccgcagacgatctggaaaccctggaaaaagcagcagttgaagcgtttaaactcggttacgaagtgaccgatccagaagagctggaagttgaagatggtgacatcgtgatttgctgcgacatcctcagcgagtgcgcgttgaatgccgacctgatcgatgcccaggttgaacaactgatgacgctggcggagaaatttgacgttgagtacgatggttggggcacttactttgaagatcctaacggcgaagacggcgacgatgaagattttgtcgatgaagacgatgacggtattcgtcactaattaagcgttgacgacaaaggctgcgttacctgatgcgctacgcatatcaggcccaggtagttcctgcaacctggtgaatttgtagcccggataaggcatttacgtcacatcctgcatactcaaaaagcacgtggttaatgttcgaatgcccgcgagtctaagctcgcgggcatttttcaaagtttgcgtagcatccgtacttcacaatcgacatgacccgtgcagccaagcgcatagtcgatatgctcaaagcccaaatgctcataaagcgcaatggcttcctttaaaaaagcggtcgtttccagatagcagcgtttgaaacccatttctcgcgcctgctccattgccattaaggccagtttttttgccagccctttgccgcggatagccggaagaaaatacatcttttgcagttcgcaaatgtctgactcactcccggttaatggcgcaatcccaccgccgccgaccacttcaccctcgtactcaaccacccaatatgcgtggccaggctgactatatacttgatacagctcgtcaaggttcggatcggcgacggtgtagcctttatcagcggtaagaccgtattcggcggatacctgacgaatgacgtgggcgatagcaggattatcggcgacggtaagtttgcgcaaacggagtgcgggagaagcgacaacattcatagcatagctcaatttcaaatgtatgatttatagctcactttaataccaccctcgcttaggtggtgcaagaagaagataaatcagaaaatattacgcatatctctctgagataaagcgtattctaggcgaaccagtatcaattgactggaattattatcggtatgaatggaatttattttagggatatagttcatgaatgatgtaaacatcgggaaagataattctcggcactcgtttgttttcacaggcaaaggtggtgagtattttcttatttgtcttgtgaattttttactgacaattattactctgggaatatatgggccgtgggcattgataaaatgccgtcgttatatttatcaacatgtgacactcaaggggcaaccatttagttataagggaacaggtggtaccatttttgttagcatgttacttattgtggcggtttatcttttcagtatttcttgttttgcaggtcaatactttgcgctcggtttattcctgtttgctctcttgatctgcggtattccttgtatggcagtgaagagcctacagtatcaggcgaatatgacttcactaaatggcattcgctttggctttaattgctcaatgctccgtgcatggtgggttatgctaggactgcctgttctgttggcgttagttttttggttcgcactgtatcttattgcacaagtgacgacatcaataggagggttattctttaacttagtcgcattaagtttgctttctgccatcgggctaggtgttgtccatggtataacctatagtaaatggatgccattgctgggtaataatgcaacttttggcattcataagttttctattcaggtaaacgtaaaagaatgcattaaaggttgcatgctcgcaatattaaccatggttcctttcatcattgtgattggtattatgatcgcaccagtattccagcagttaatgatgatgaccatgttgggtaggtctgatgctggcagtgagtttgtattacaatattacccgcagattatggcttcctactttctgtattttgtcgcgatccttgtgtttgccagttatctctatgtcacgttacgcagtttgttcctgaataatctgacactggcaaatggcactattcgttttcattcatctgttaccgcgatcggtatgcttctgcgcatgttggcggtattaatggggtcctcaattacctgtggtctggcttatccctggctgaaaatgtggatggttagctggattgctaacaatacccatgtccagggcgaccttgattcgctggagttaaccaatgatgacaaaccgcaggatagcggttcgttaatgtggatatctcgcggtattatgccgtatgttccgtttatctaaataaaaaggccggagcatgctccggccttcgttttcactatgagtattacagcgcggcgataacagcctgctgttcaatcagcttcgctttcgcttctgcgtagccttccagcttctcacgctctttcgcgatgaccgcttccggtgcgcgggcgacaaagccttcgttcgccagcttgttctcaatacggctgatttcgccttcgatcttcgctacttctttcgccagacgtgccagctcatcttctttgttgatgaggcctgccatcgggatcagcagttctgcgccgtcgacgatctttgtaacggaaaccggacctttatcatcagcaggcagcacggtgatgctttccagacgcgccagcgtttgcaggaagccgcggttttcatttacgcgacgttctgcatccgcgctgcaaccacgcagcagcagctccagcggtttacccggcgcgatgttcatttctgcacggatgttacgtacagcaacgatcgcctgtttcagccactcggtgtcggccagtgccgcttcatcaacctgagacgcatcgtactgcgggaacggctgcagcatgatggtgtcggcagtgataccgcaaagtactttcacacgctgccagatggtttcggtgatgaacggaatgatcggatgcgcgaggcgcagcagaccttccagtacagtcaccagcgtatggcgagtaccgcgcagttcggcttctgttccaccgttcattaccggcttggtcagctccagataccagtcacagaactggttccaggtgaattcatacagaatgcctgcggcgatatcgaagcggaagctgtccagcgcttcgcggtacgctttgatggtctggttgaactccgccagaatccagcgatccgccagcgacagcgtcatttcaccgccgttgaagccgcaatcctgaccttccgtgttcatcagcacaaaacggctggcgttccacagcttgttacagaagttacggtagccttccagacgcttcatatcccagttgatgtcacgaccggtagaagccagcgccgccagggtgaagcgcagcgcgtcagtaccgtgcggctcaatgccgttcgggaactgcttctcggtgcgcttacggattttgtccgccagctgcggctgcatcatattgccggtacgtttttccagcagttccggcagcgaaataccgtcaaccatatccagtgggtcaatcacgttacctttggatttggacatcttctggccttcgtcatcacgaatcaggccggtcatgtaaacggtgtggaacggcacctgtggtttgccattttcatctttgatgaagtgcatggtcatcatgatcatgcgggcaatccagaagaagatgatgtcgaagccggataccatcacgctggttgggtggaactggcgcagtgcgtcggtgttttccggccagccgagcgtggagaaggtccacagcgcggaggagaaccaggtgtcgagaacgtcttcatcctgacgcagcgcaacatcagcaccgaggttattttctttacgcacttcgtcttcgttgcggccaacataaacattacccgcttcgtcataccatgccgggatacggtgaccccaccatagctgacgagagatacaccagtcctgaatatcgcgcatccaggagaaatacatgttttcgtactgcttcggtacgaactgaatgtcgccgttctcaaccgcttcaaccgctggtttcgccagtacatcggcacgaacgtaccactggtcggtcagcatcggttcgataaccacgccgccacggtcgccgtaaggaacggtcaggtcgtgcggtttaatttcttccagcaggccgagcgcgtcaaccgcagcaacgacggctttacgtgcagcaaaacgctccagtttctggaactctgccgggatttcgctggaataaacgtcagattcgttacctttggtatcgaacacctgggcgcttgcacggatatcgccgtcaaaggtcaggatgttgatcatcgacagggcgtgacgtttaccgacttcatagtcgttaaagtcgtgcgctggggtgatcttcacgcagccggtgcctttttccatgtcggcgtgttcgtcgccaacgatcggaatacgacggttaaccagcggcagaatgacatatttgccaatcagatctttataacgcggatcttccgggttaacggccacgccagtatcgcccagcagggtttccggacgggtagtcgcaaccaccagataatctttaccgtctgcggttttcgcgccgtcagccagcggatagcggatgtgccacatcgaacctttcgattcgcggttttccacttccaggtcggagatagcggtgcgcagtttcgggtcccagtttaccaggcgtttgccacggtaaatcaggtcttctttatacagacgaacgaaaacttctttcaccgcattggacaggccttcgtccatggtgaagcgttcacgctcccagtcgacggagttgccgagacggcgcatctgacgggtaatggtgccgccggattccgctttccattcccagattttgtcgatgaaagcttcgcggccgtagtcgtgacgggttttaccttcttctgcggcaatcttgcgctcaacgaccatctgggtagcgatcccggcgtggtcagtaccgacctgccacagggtgtttttgccctgcatgcgctgatagcggatcatggtatccatgatggtttgctggaaggcgtgacccatatgcaaactgccggtgacgttcggcggcgggatcatgatgcagaaactttcctggctttcatcgccattaggcttaaagtagccctgcttttcccagtgctcgtaaagcggctgttcgatatcttgtgggttatatgtcttttccattatttccaggttgccgtattcaggttgaaaccagccacgcggtaggctttatagcgttcgcgcgccagttgtttcagagaatcttcataaggaacgaagtctaccacttctgtgaaagcggtggcaaaatctgcaaagcttgttcgcagactaatcaatatatcgcgcgggctgctgctgcgcttttgcggccaggcgatctccaccggcgcaccgccgcgcggtccttctcccgctaaattatgcggaacaaagctttctgccggacgcgcccacagggcttcatccagtcggtaagcctgcttttcatcttcacaggcgatgagtacgcgcttaccactgcgccaacgttctgcggcaatttcacacaccaactgctcaacggcgcttaagccatcgacggtggtgtcattgtccagaaggtagaacgttgcgtttttcatatatggggcttcttgtggtggatttaaatacgcatcaggtatacaccgcagcgcctgatgcgacgctgccgcgtcttatcaggcctacaagttaagtgctgtgtgtaggtcggataaggcgttcacgtcgcatccgacaataacaaccttgcctgatgcgacgctgtcgcgtcttatcaggcctacgagttcagtactgtgtaggtcggataaggcgttcacgccgcatccgacaataacaacacagcctgatacaattactcttcgccgttaaacccggcgcggtttagcaggaactgtgccagcaacgccaccgggcgaccggttgcgcctttcgccttaccagaacgccaggcagtaccggcgatatccaggtgcgcccagttatacttacgggtaaagcgcgacaggaagcaacctgcggtaatcgccccaccaggacgaccgccaatgttcgccatatcggcaaaattggactccagctgttcctgatactcgtcacccagcggtaaacgccatgcgcggtcaccggattgttcagatgcagcaatcagctcatgggccagcggattgtggttcgccatcagaccagtaatatgatgacccagcgcgatcacgcaggcaccggtcagcgtcgccacatcaatcaccgcttccggctcaaaacgctccacgtaagttaatacgtcgcacagtaccaggcggccttcagcgtcggtattcagcacttcaacggtttgaccggacatggtggttaacacatcgcccggacgataggcacgcccgccaggcatgttttcgcagccagccagcacgccgataacgttaatcggcagttgcagctctgcgaccatacgcatcacgccgtaaaccgctgccgcaccgcacatatcgtacttcatttcatccatgccttctgaaggcttgatcgagataccgccggagtcgaaggttaaacctttacccaccagcacgattgggcgtgcatcttccgacgcgttgcctttgtactcaatcactgacatcagcgattcgttttgcgaaccctgaccgaccgccagataggaatgcatccccagctctttcatctgctgttcgccgataactcgggtgatgacattcttgctgtagctgtcagccaactggcgcgcctgagaggcgaggtaagcagcgttacagatattcggtggcatattgccgagatctttcgcggctttaatccctgcggcaatcgccagaccatgctggatcgcgcgttcaccgctggtcagctcacggcgggtcggcacgttgaacaccattttacgcagcggacgacgcggttcgctcttgttcgttttcaactgatcgaaactgtagagcgtctcttttgccgtctcgacagcctgacgcactttccagtagttgttacggcctttaacgtgcagttcagtcagaaagcagaccgcttccattgagccagtatcattcagcgtattaatggttttctgaataacctgcttgtactgacgctcatccagctcacgttctttgccgcaaccaataaggagaattcgctcggaaagtacattcggcacatggtgcagcaacaatgtctgccccggttttccttccagttcgccccgacgtagcagggcgctgatgtacccatcgctgattttatcgagctgttctgcaatcggagaaaggcgacgtggttcgaagacgcccacgacgatgcaggcactccgctgtttctccgggctaccgctttttacactaaactccatgcactacgctcctgaatcttaaagacaacggcggtggctacagatagaattgcaagctttcgtaactcatgtccgctgttgcgatgacttcgtgttaatcttaacgttattacggcattggcacgtcagaacaaaatctgagaggtgaatccgttgagtataattatcttagcgacgatttcgacgactcaagagaataaatgacgtttaagccatgaaacaagctaaaatcctgcaaaagacgagtttttacgggcgtatttaaagtgataatcataagatatctggtgcgggagacgctcaaaagccagctggcgatactcttcatcttgcttttgatcttcttctgtcaaaagttagtgaggatcctcggcgcagcggttgacggcgatattccggcgaacctggtgctctcccttctcgggttgggcgtgccggaaatggcgcagcttatcctgccattaagcctgttcctcgggctgctgatgacgctgggcaaactgtataccgaaagtgaaattacggtaatgcatgcctgcggtctgagcaaagcggtgctggtgaaagcggcaatgatccttgcggtgttcacggcaatcgtcgcggcggttaacgtgatgtgggcgggaccatggtcatcgcgtcatcaggatgaagtgttagcagaagcgaaagcgaaccctggcatggcggcgctggcgcaagggcaattccagcaagcgactaatggcagctcggtgctgttcatcgaaagcgttgacggcagcgatttcaaagatgtgttcctcgcgcaaattcgaccaaaaggtaatgcacgaccttctgtggtggtggccgattccggacatttaacccagctgcgcgacggctcccaggtcgtcactctcaaccagggaacgcgcttcgaaggcactgcactgttacgtgatttccgcattacggatttccaggattatcaggcgatcattggtcaccaggcggtggcgctcgacccgaacgataccgaccagatggacatgagcacattgtggaacactgacaccgatcgtgctcgcgcagaactgaactggcgtatcacgttggtgttcaccgtgtttatgatggcacttatggtcgtaccgctgagcgtggttaacccgcgtcaggggcgcgtactatcgatgctgccagccatgctgctgtatctgttgttcttcctgatccagacctccctgaaatcgaacggcggtaaaggtaagctggacccgacgctgtggatgtggaccgttaacctgatttatctggctttggcgattgttctcaacctttgggacaccgtgccggtccgccgcctgcgcgccagtttttcgcgtaaaggagcggtgtgatgcaaccttttggcgtacttgaccgctatatcggtaaaactattttcaccaccatcatgatgacgctgttcatgctggtgtcgctgtccggcattatcaagtttgtcgatcagctgaaaaaagccgggcaggggagttacgacgcgttaggcgcaggaatgtataccttgctgagcgtgccgaaagatgtgcaaatcttcttcccgatggcggctctgcttggggcgttgcttggtcttgggatgctggcgcagcgcagcgaactggtggtgatgcaggcttctggttttacccgtatgcaggtggcgctgtcggtgatgaaaaccgccattccgctggtcttgctgacgatggcgattggtgaatgggtcgcgccgcagggcgagcagatggcgcgtaactaccgtgcgcaggcgatgtacggcggctcgttgctctctacccagcaaggtttatgggcgaaagatggcaacaacttcgtctacattgagcgggttaaaggtgacgaagagttaggtggcatcagtatttatgcctttaacgagaatcgtcgtctgcaatccgtacgctatgccgctaccgcgaagtttgacccggaacataaagtctggcgtctgtcgcaggttgatgaatctgatttgaccaatccgaaacagatcaccggttcgcagacggtgagcggcacctggaaaaccaacctcacgccagacaaactgggcgtggtggcgctggacccggatgcactctctatcagcggtttgcacaactatgtgaagtatctgaagtcgagcggtcaggatgccggacgttatcagctcaacatgtggagcaaaatcttccagccgctatccgtggcggtgatgatgctgatggcgctgtcgttcatctttggcccactgcgtagcgtaccgatgggcgtgcgtgtggtcactggtattagcttcggttttgtcttctacgtactggaccagatcttcggcccgctgacgttggtttacggcatcccaccgatcatcggcgcactgttgccaagtgccagcttcttcttaatcagcctgtggctgttaatgagaaaatcgtaaccgaatgaacgaataaagggagcgaaagctccctttattattgttagcaaagtgtgtttcgttcatgcctgaaaaaatcatgaaaattcaatatattgcagtagtgtaggcctgatgcggcgcgccagcgttgcatcaggcaaagacaaatcgcacctggcttaccttcttctcccccccagcaaactccccaacatcccgcgcacaatctgattcgtcacctggcgggcggcgctttttgccattgtttgcaccacaccatctttcttcccgccgcgtggtccggtagtgccgaacaaaatatctttcaatccaccgagaataccgtcatccaccgccacctctttccctttcgcgggaggattattttgctgctcgatactggcccgaaagcctttttgcaacatctcataggcggattcccggtccacgtcatcctcgtacttgccatacaccggggagtggttaatcaagccattgcgctcatcttccgtcaccggccccattcgtgaacagggggcaatcaccatcgcccgttccaccactgaagggcttcctttcgcatcgagaaacgagattaacgcctcgccggtccccagttcctggattgccttttcggtatcaaatgttggattggcccgcatggtttgcgccactgccttcactgctttctgatctttaggcgtaaaagcacgcaaagcgtgttgaacgcgattaccgagctgccctagcacgttatccgggatatctgacgggttttgcgaaacgaaccagacgcccacgccttttgagcgaataagccttatcacctgctcaatcttatccagcagtacctgcggtgcatcgttaaacagcagatgtgcttcatcgaagaaaaacaccagttttggtttctccagatcgcccgcttccggcaattgttcatacaactctgaaagcatccacagcaggctggcggcgtacagtttcggcatctgataaagcttctcggcgctgaggatattgataacgcctttaccgttggcatcggtgcgcatccagtctttgatatccagcatcggctcaccaaagaagtgtgctgcgccttgctgttccagcgacaacagcccgcgctggatggcaccaaccgatgcactactgatattaccgtactgattctggaaggatttggcgttatcgccgatgtactgggtaattgcccgcagatctttaaagtcgagcagcaacaatccctgatcgtcagcaatgcggaaaatgatattcagcacgccagattgcacatcgttgagattcaacagccgcgccagcaacagcggccccagatccgaaaccgtcgcccgcaccgggtggcctttctcgccaaagatatcccacaccaccaccggattagtatgaggttgccagtcatttacgccgatatttttaagccttgcgagcagtttttccgaagatgtaccttcctccgcaactcccgttaaatcacctttcacatcagccataaacacaggcacgccgatttccgacaatgactccgccagtttttgcagcgtaacggttttacccgtccccgttgcgccggtaatcagcccgtgacggttagccattcccggcagtaaaaacagttctgtgtccggcgtgcgggcaattaacaggggttcgctcatgagatttcctccagtttcctgcctggagtataggcaacgtccggcaaagagaatatgtgtaatgcagagaaaataacctaaagcgtgttaccgtgataaatctgatacccgaggtcaacagtgttgtggttgtgatcgttattcttaattttgctcagcaacatttgggcggccatccgaccaatatcaaaacggggagtaattacgctggcgaggcttgggatcatttgcctgccaatctccagcccatgaaaacccgcaatggaaatttgttctggcacggcgaggtttcgctcgcggcacagcagaagcgcacccatcgcaatatcgtcattggtgcaaaatacaccgtctaaatccgggtttgcgctaagggcatcacgcattaactgcattcctaaatgaatggatgagatggcgcgtggattcatgcgtaatggggaaagattatgcagcatcatcgcatcgcaatacccctgataacgctgttcatcgcgggtgtcatctttggaaccgagatacagaattttgcgcctgactcgcttatccagcatggtacacaccatgtcaaaagcagcctgccgattatcaaaaccgacctccatatccagccgttctccctgtacatccatcaattccacgaccggaatggtggctgaacgcagaaatttcaccgtcctgatggtgtgatatttttccgaaagaataatcccgtcaatgttataagagagcaggttaatcaccgactcttcttcggaatcgcgattgtaattgtaattagcaataagggtctgataattatgcacagaggtgacggattctattcccgcgagaatgtcagcgaagagttgattttgaaatgacggaatcaagataccgagggtataactttgtgcattcaacaacatgccgggagcgcgattagggatataattgatctcttccataattttggcgatgcgctcgcctgtttcctttgccacctttttcggcgagcggatataacgactcacggtcatttttgttacgccagccagcgtagcgatatcctgtaaagaaattctgtgattgcgcataacttctcccaacgtcgggggaatcttcaatcttcccccgaaactacatcacaatattttattctttcagtgcaatacggcgttaatggctaacacgcccagcaaacccataatagaaataagggtttccatcaccgtccaggtacgcaacgtttcaccaaccgtcagattaaaataccctttaaatagccagaagccagggtcgtttacgtgtgacgcgatcacgctgcccgcaccagttgccagtaccattaaagcgggatcggcatgggtaacgttgataatcggcaacaccacacccgcggtggtaatggccgcgacggtggcagagcccagagcgatacgcaacagcgccgcgacagtccagcacatcaataacggcgaaagcgtagttccggtcattaagtgtgaaatatactgcccgacaccgctatctactaatacctgcttaaacgcgccgccgccagcgataataaacacaatcatcgcgatagcgcctatagaatccccaatgatatccatgatttgctcgatggtgcgtccattacgtcggcccagtgtgaaaatcgcaataacaatggcaataaacagcgcaacggcagggttaccgacaaattcaaagaagaggcgcacggtgttagttttcggtaacgtaatttcacaaacggcggcgatagccatcaggatgaccgggatcactgcagcaaaaatactgttccagaaggagggcatctcctcttcgctaaacagatgaggattaaataagccttccggtggtgctttctcaaagcgagttagcagtttagaaaacagcggtcctgcgacaataactgtcggaatggtaatgataaatccatacagtaaagtcgttccgagattagcctcaaagatagtcgcgatggcagtaggccctggatgtggcggcagaaaacagtgggttacagagagcgctgctaccatcggtacgccaacatacaacaggggtaatccagatgatgccacgatggtaaataccaacggcaacagcaggacaaaacccacttcaaaaaacatggcgaggccacaaccagaccggtgatcactagcgcccattgcacgcgttttttaccaaaagtagcaatcagcgtagtggcgatacgttgtgccgcgcccgtatcagaaatcagcttgcctaacatggccccgaaaccgaggatcattgccagcccgccgagtgtgctgccgataccattttgtatagagtgcaggacggcctgtgcatccatcccttcggcaaatccgacgacggcagcgaccagaacgagggcaataaagccgttaactttaaagccgatcatcaggataagaagcagcgcgacgcctgccgcaataatgattaatggcatagtctttatctcttattagtgccagaaaagcagcgctttcgtgctgcacgtagggtagtagctgttaaacagccactaacatgccgccatcaacaaacaacaggtggccgtttacgaaatcagaggcttttgaagaaaggaacaccgcagcaccaatcagttcctgcggatctccccagcgtgcggcgggggtccgtttgcacaaccaggcggtgaaggcttcgtcctcaaccagtgctttagtcatttctgttttgaaatagcccggcgcaataccgttgacctgaatattgtggcgcgacagctcgacgcacatgccgcgggtgagcatttttaccgcccctttcgatgcggcataaggggtgatggtgtcacgtcccagttcgctttgcatcgagcaaatattaataactttacctgccttgcgttcaaccatgtgacgagttaccgcttgcgacaccaggaacacggcggtctggtttactgcgatcacatcattccactcttgttcagggaactcagtaaaaggatgacggcgctggataccggcgttattcaccagcacatcaatggggccgatgtccttttcgatatgttcaacggcggcatcaatttcatgtttatgagtaacattaaaaggtgcggcaacggcctgaataccctcctggtggagtttttctacagcaagttctgcgcgttcggcagtaatatcattaataattatttgtgcgccatatttacccaggccggttgccagtaaaaagccaatgccctgtgctgaaccggtaatcaagatattttttcctgccagtgaaaatagatcgttcattgtattattcctttatttatctcttagaaaacaagctggacttttgctgcctgggttttatcaccggcgaaacgtagcgcctcttccaggtcagtgaagggatattcagcactcagtaaaggcagtggattaataacgccattcgccagccatgacactgcggtattaaattcgctggtaaaacggaaagagcctttgagtgaaatctccttaccaatcaatgtcatcattgggaattctgccatcgcgcctcccatacctacctgcaccattacgccgcgtgcacgagtgacctccagacaggtattcactgatgaaggatgaccggacacttcaaagctgacatcgaaatagcctttttccgctttccagtgatccatgtcgtcgttttgtgggtttacgagcacatccgcccccatctctttgcccagcgaaagggaacggggactcacatcggcacagacaatttccgcggcccccagtgttttcactgcactgacaatcaggcagccaatgggcccaacaccagaaataaatactcgcttgccctgtaactcgccggcctgatgtgcggcatgaattgcgacggctaaaggttcggcaaaagctataaccttttcgtcagctttggccggataagggacacattgcgacgtttcgaccattttataacgggtaaagccaccatcaacatgagggaaatacatggcactgccaaaaaaacgcatctctgtacactgattctcgttatgttcaatgcagtatttgcagtgaccgcacggtttagacggattaatggctaccgtttgcccttcatgtaattttgatgagtcgctatgaataactttaccgataacttcatgacctaacaccatcggtgcctttatcatgaaattacctacttttccttcctgataataatgtaaatcggaaccgcaaattccacctcgggttatttgtactaatgttccattattattccaatctatcgtctgctcggtaacggcaacagttttcttgcccgcaacaacgcaggactgtgttttcacttgcataaattcctcactggtcaggtagacacctcggaagcatttaagcggttttaattgtcattatttgtgatgaagatcacgtcagaaaattgttacattactatgttacgcataacgtgatgtgccttgtaattcttatcaacagaaataaaaaaacgtgaaattattatgccgccaggcgtagtatcgccgcaggtaagatgattcaggagattttaaatggcgggtgaaagctttattttgatgggcgtatcagggagtggtaaaacattaattggtagcaaggttgccgcgttattgtctgcgaaatttattgatggtgacgatcttcatccagccaaaaatatagataaaatgtcgcaaggcattccattatctgatgaagatcgacttccctggctggaacgcttaaatgatgcttcatacagtctttataaaaagaatgaaacaggatttattgtctgttcatcattaaaaaaacagtatcgtgatattttacgcaagggtagcccccatgttcatttcctctggttagatggcgattatgaaactattctcgcgcgaatgcagcgtcgggctgggcattttatgccggtagcgttactaaaaagtcagtttgaggcgctggagcgtccacaagcagatgaacaggatattgtgcgcattgatatcaaccatgatattgccaatgtcaccgaacaatgtcggcaggctgtgctggcgataagacaaaacagaatatgtgcgaaagagggcagcgcctcagatcagcgctgcgaatgattttcaaaaatctgctttcaacaccacgcggtagcgcgctttaccatcgcgcacatgctggatggcgtcgttaattttcgacatcgggaacagttcggtagtcggcgcaaccttgctgcgggcggcaaagcgcatcagcttacgcaactcataaggtgtaccggttgctgaaccagagacgctgtggtcgcccgcaattaacgtaaaggccggaacagacagcggcgtgaggaccgcaccgaccgtatggaaattaccgccataggtcagcgcctcaaaatagggctgccagtcgaggctgacgttgacggtgttgataatgagatcaaactgccccgccagtgctttcagtgcctgtggatcgcggctattcaccactttatcggcacccatcgccagcacttcctgctctttcgccggattagaactaaaggctgtcacctcgcatcccattgcgtgcagaagttttatagctatatgccccagcccgccaataccaattaccccaacgcggctggtggcagtgatatggtgcatcaacagcggtttaaagaccgtgataccgccgcacaacagcggtccggcagattcaatgtcgatattttctggcagtggaatcacccattgccagtccgcacgcaacttctcggcaaagccaccgcgattcataatcgtcggcaccgcaccttgctcgcagttgatctgattaccgctaatacaggcatcgcaatgcccgcagctgcgtgccgtccagccaatcccgacatgctgaccgacctgcaaacctttatcctgcgcggcactcccgagcgccactacgcgaccaatcacctcatgcccggcaaccagtggatattgtgaaaatccccattcgttatcgatcattgacagatcggaatgacagatcccgcagtaatccacctgcacttcaacatcttgtggcttcagttcaccgggatcgtactcataaacttccagttcgccacccgcttcttttgcggcatagctttttatcatcgacattttttggtccttctctggtgtggtctgggaagtgtagagcatggcagggcggggtgcctagagtgtgacaaaggttacacatcgctgtatgcaatgctgaaaatttcagcacttagcgaggtgcgagcaagctggcgcttgcatggtggcgtgcgacaggtataatccacaacgttttccgcatacctcttcagtgccgaagtggcgaaatcggtagacgcagttgattcaaaatcaaccgtagaaatacgtgccggttcgagtccggccttcggcaccaaaagtatgtaaatagacctcaactgaggtctttttttatgcctgaaatccagtgtttatctatctttcccgctatattaactctctcaaggtcaaccgatatcaacgtacatctaccaacatatgttggtacagatgatggtatttccggttcgataatgcttgtaccaacagggagggaatacgcatggcattaacagatatcaaagtcagagcagccaagccaacggataagcaatataagctgactgatggtggcggtatgcatctgcttgtccatccaaatggttctaagtactggcgtttgcagtaccgttatgagggaaagcaaaaaatgctggcacttggggtttatcctgaaatcacactagcggatgccagagtacgtcgtgacgaggcgcgtaacctgcttgcgaatggcgtcgatccgggagacaaaaagaaaaatgataaggttgaacagagtaaagcacgaacctttaaagaagtcgcgattgagtggcatggcaccaataaaaagtggtctgaagatcacgcccatcgtgtgctaaaaagtcttgaagataatctttttgcagcgcttggtgaacgtaatatcgctgagttaaaaactcgagatttattagcacctattaaggccgtagaaatgtctggacgtcttgaagtggccgctcgtcttcagcagcgcactacagccatcatgcgctatgcagtgcaaagtgggttaattgattataacccggcacaagagatggctggggcggttgcttcctgtaatcgacaacatcgtcccgcgcttgaattaaagcgcatccctgagttgcttgcaaaaatagatagctatactggtaggccgctaacccgatgggcgatagaactcactttgctgatctttattcggtccagtgagctgcgttttgctcgttggtcagagatcgatttcgaagcgtctatatggactatcccaccggagcgggagcctattcctggagtgaaacattcccatagaggctcaaaaatgcgtacaacgcatctagtgcctctttcaacgcaagctcttgcaattttaaagcagataaaacagttttatggggcccatgacttgatatttattggtgatcacgattcgcacaaacccatgagtgagaatacggtaaatagtgcgttacgggtcatggggtatgatacaaaagtagaggtttgtggtcatggctttcgaacaatggcctgtagttcattggtcgaatcaggtttgtggtctcgtgatgctgttgaacgtcagatgagccacatggagcgaaattcagtgagggccgcgtatatccataaagcagagcatctggaagaacggcgattgatgctacagtggtgggccgattttctggatgtaaacagagaaagatttatcagtccatttgaatatgcaaagattaataatccattaaaacagtaatcatcccgggcaaatgcccgggaattattctaggattattttctttgttaaaaaagacaaacggtattaactgatgtatttactatttaccgctccctgcaggggggattatcagaatccgcggttattcattatttatatactttcaataaaaaagtaacctcataaaaaatcctgtactcacagggtgatgcgggataactgacgtaaggagtgctgcagggatttgatggtcccttgtgctgatatgaatacggatattttatacagaatacttttcagtacaagcgactgtattacagtctgccatatatgattacctgtgatcaggaagaataagtggctgaggtttcaaactgtctgccggtatattcctctctcccttaaaaaccataacagtttaattatcttcgtctgtcagcggattgaatggcggtatattttcagtacaaataccggtcatccactgaaaaatacctgcgaaatgacgggcactgatttttctactgacgggctgatgagacgttatgtcactgacatataatccctgcgcacactctcaccagtgacaataacaatcgtatcatataacggtgctcccggctggattttccagttgtcagccccgtgctgactcagttgttcataacgctgcatttcacgtaatgtgtcagttgtccccacaactgttcctttaaccatccgcaatggccaacggtttacagagcataatacgaatagccgtagagccagccagttacggtggtcgcgatggtgtgtccgccagaaaatcaccacgaataccagaatcgcggcactgaccagaaaatgataaacaggaaacacggggcggttcactttgctttctcctgtagtgttttctgtaggttctgaaccggttcgagcggggttgtgaggctgatggcaatccccgggctcttcctgcatgttacaccggtactgcaagagggggccttcgctcctctgacattactcagtattttcactactacaccccatctgccatccataacaaccgattcaccccctcgcgaggcgttgttgcccgtcacccggacagacatcgttatggacttctcttgttgcacgatcgatcaattgttatgcatgctgacaccacaaccccggtgggtatgaccgatgcctttctcactctcttcccggtcatcgtcggccttccccgttattgtggagtgtcagcaccctcgacggcatttcgatggctgctcagtgttcactcacgttacggcccgcataacccgttgacttcctgaagaagtcgtttcagggagagattcagcccttttgttacctcctggaccgcttcttgtccttccagtcggagcgagagttagccggggcggactttcaccgacggaaagatcgtgcatttcaaggcacacacaacaatatctgcgagcgtgctatccgtccggtcgttatgggacgaaaggcctggttgttcgctggttcactgatggccgggaaccgcgcggcacagataatgagccttctgggaaccgcagtctggagccacatgcttggctgacggacgtcctgacgcgtctgccggagtggccggaggagaggttggctgagttactgcctcttgagggctttaccttcttcgggtaagtgatacctgccgtcaggtgtttgtgcaccgggccataacctgcagttgggaattgaacgcctgacaacaggaaatgagctagggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccttggcccggatgctggctttcatgtattcgatgttgatggccgttttgctcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgactaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtcaggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttccatggctccagatgacaaacatgatctcatatcagggacttgttcgcaccttccatcagagaccagggatatcgtggcggaatgaccattctcagggcgttcattcgttctctctcggtttctcaggagcaggagcctgccgttcggttcgaaactgaacccggacgacagatgcaggttgactggggcactatgcgtaatggtcgctcaccgcttcacgtgttcgttgctgttcccggatacagccgaatgttgtacatcgaattcactgacaatatgcgttatgacacgctggagacctgccatcgtaatgcgttccgcttctttggtggtgtgccgcgcgaagtgttgtatgacaatatgaaaactgtggttctgcaacgtgacgcatatcagaccggtcagcaccggttccatccttcgctgtggcagttcggcaaggagatgggcttctctccccgactgtgtcgccccttcagggcacagactaaaggtaaggtggaacggatggtgcagtacacccgtaacagtttttacatcccactaatgactcgcctgcgcccgatggggatcactgtcgatgttgaaacagccaaccgccacggtctgcgctggctgcacgatgtcgctaaccaacgaaagcatgaaacaatccaggcccgtccctgcgatcgctggctcgaagagcagcagtccatgctggcactgcctccggagaaaaaagagtatgacgtgcatcctggtgaaaatctggtgaacttcgataaacaccccctgcatcatccactctccatctacgactcattctgcagaggagtggcgtgatgatggaactgcaacatcaacgactgatggcgctcgccgggcagttgcaactggaaagccttataagcgcagcgcctgcgctgtcacaacaggcagtagaccaggaatggagttatatggacttcctggagcatctgcttcatgaagaaaaactggcacgtcattaacgtaaacaggcgatgtatacccgaatggcagccttcccggcggtgaaaacgttcgaagagtatgacttcacattcgccaccggagcaccgcagaagcaactccagtcgttacgctcactcagcttcatagaacgtaatgaaaatatcgtattactggggccatcaggtgtggggaaaacccatctggcaatagcgatgggctatgaagcagtccgtgcaggtatcaaggttcgcttcacaacagcagcagatctgttacttcagttatctacggcacaacgtcagggccgttataaaacgacgcttcagcgtggagtaatggccccccgcctgctcatcattgatgaaataggctatctgccgttcagtcaggaagaagcaaaactgttcttccaggtcatcgctaaacgttacgaaaagagcgcaatgatcctgacatccaatctgccgttcgggcagtgggatcaaacgttcgccggtgatgcagcactgacctcagcgatgctggaccgtatcttacaccactcacatgtcgttcaaatcaaaggagaaagctatcgactcagacagaaacgaaaggccggggttatagctgaagctaatcctgagtaaaacggtggatcaatattgggccgttggtggagatataagtggatcacttttcatccgtcgttgacacaatggcatcgactcccgtcgcaagaaaaccattctgcgtcagcagttcaaggccactgcggatcagatcattacgagtatctgcataggtactttctgtctttcgcggccttccccggccacgattttcgcctgtcatgacccatctcctacattttattgtcaaaagaataagtgattttgcgcgagagcttcaatcagtttatccccgcagtggcaaagtgttcgcttttgccgactggacagtggcagtgcctgtcgctactgcgccatcgctgaacagtgcagaattagcaacgtttgcttttggcacaaagcatacgcccattctcacgcgaatgctttgcccttgacttgccaacaaccgaattgcttgctctgcagctatgtttttttattagaatattcgccactaaataaattataataagttgattttattagatatctatcagaatctatatggtcagcacgagttgcatgctctaatgtttcaaatgccagggtatgtgcggcttcagcaaatatctcaggccaacctttactcagcatcgacagtcctttaaggactcttatctgaatctccctcatactggcaccatcgcgcgcgacaggtgagaaaaagtcttccagtagatcgttattctgaagtggtgcaacatgtactgaaggatatttcacttctatttcatcagatttattctgcgcgtaagtggaaagtatacgaacacctctgccaatgacatcaatggcggttccaggatcgttcactgcaggggaaagggcccggcaggctatttcggccatgacgctaagacaaaatcgaggatcctgagcaaatgaacgtgcatccgagacaataatcgtctcaagtaaatcggtgttgattgacgactcctggccctgactcaggtacaaaactggcatggacggatgtatgaaactgcctggctgcgccacgaggtatacatgacggggatcattggtcagcagcttgctaagtttcaccatatcaatatattcaacatagccaatcttcttcggataaactgcaaccgttcctttcggctgttcattgttctcaagccatggatatccgccgagacagggatttcttgctctcgcaataaatgtttcgatggccgcctgttctacttgtgccgttgtctcaccaaccctccccagagaggtcaaatgctgtatccagcgaagcaatgtgatgaggattaaggcaatgacaaccagtgtgacaatgaataaaatgactctccccctttctccataagctcccatattgagggcaataatccctaccagactgaagagaaaagaaccgatgaaggtggccagtacattttgtgtggtgacgtcttcaacaactaaacgcgtagctctgggagtcacattagtagtggctgaaccgtaggctgtgaccatgatactcagcgaaaatgtggtcactgccagcatactcgatgccagtatgttcagaatgttatcgactgcttccgcaccaaccttcacggaaaccgactcaggtatcattgatttaaaaagaattgataaaagggccgttattatcgcgacaattgcgaataacgttgccctgaaccatagttttttaattgtctgcttcagcatccatttccagcgtgaaatcattctgcattccctcatattgcggccgggataataattgccgcccccaggacggcatgttgctattaacgaaccaggtgcaggaagtgcaggtgtttttcgtactggtccagtatgtcattaatcagctgttcctggttccagcccatcacatcataattttgaccgccttctttgagataaacctcagcgcgataatatcgatgttgttcagtctgctgctcatcattatccattgcggcgagcgcgaaggtcggtgagatatacccgcgaagcctcacttcatatataaaattcagctcgttgcccaaatcgacttcaagacgaatacgatcgtcgactgcatcactaatgtggcttatcgtcccctgcttgttcagttcctcctgaaccagcgtcatggcgggctggataacgtcgtccataaaacgtttcacaagagatcgcttcggcagatacgcgatattgcgtaaccttctctgccaaggaattgggttacgtgcagccgtaggagcaattgtcgccatgctcaggctttcacgcttggtcaaatcccggcgcaaagcttttaaaagtccgtatatagatattagtaagatcactgagaagggcaatgcactcgctattgtcaccgtttgcagcgcacttagccctccggcaaggagaagcgcaattgcaacaatgcccatgagcgaggcccagaatattcgctgccagacgggtgtgtttgccactccacctgatgccagagtatccacaaccattgcccccgaatcagcagacgttacaaagaagacgatgaccatcgccattgcaatgaatgacagcacagaagagaacgggaaatgctccaggaaattaaacagggccagcgccacatcctgctgaacagtattggcgaggtctgtggccccctggttcataatgagatagatcgcgctgttaccaaacaccgtcatccacattagcgtaaaacccgcgggaacaaacagcacgccggtgacaaactcgcgaatggttcgcccgcgggagacccgtgcgatgaacatccccacaaacggcgaccatgaaagccaccatccccagtacagtaatgtccagccccccagccagttgctcgacttgggctcatacgcgtaaaggttgaacgttttactcaccagttccgaaagataaccgcccgtattttccacaaatgacttcagcagaagcacggttggtcccagacacaggaccagcgccaggagcaacaaagccagacccagattgagttcagacaggatacgtattcccttatccagaccggacaccactgaaatcgtcgctaaccccgtgatgaccacgatcagaattacctgcaccgtttcattgatgggcaccccgaaaagatggttcaaaccggcattcacctgcaaaacaccgtaacccagtgatgtcgcaacgccaaagaccgtgcctataacagcgaaaatatcaaccgcatgtcctacaggtccgtatatgcgatcgccaataatgggatagagtgcggagcgcagagttaaaggcagaccgtgacggtaactgaagaacgccagaatcagcgccacaatggcataaattgcccatgcgtgcagtccccagtggaaaaaggtcagacgcattgcttccttagctgccgcaacggtttctggagtgccaacgggtggcgaaagataatgcattacaggttcggcaacgccaaagaacatcaggccgatccccatccctgccgaaaaaagcatcgcaaaccaggagtggtagctgaaatcaggctgcgcatggtccgggcccagcttgatatcaccgtagcgtgagagtccaaggaacgtgacactcagtaaaatcagggccacagcaaggatgtagaaccagctggcattcgtgaagatttgttgctgaagtagtttaaaatttttgtcggcgacatccgggaatacggcggcaaaggcgacaagaaggaaaattagcaaagcagatgtaaagaataccgctttgttaatctgacttgtagacttctttgggattgtatcattttcactcataatcatttattccattaattaaattcgcactggatagaaggtactacctctcacaaagtagcaaagttcaactggctatgcggcgttaatcggaatgcatggtggaatgttgaggtgtactggcaatagcggacactaccagttgttctttttttaagcagccatctgatgatatttttccctgaaggctgccggggagatattccccagacgagagtgacgacgctgacgattgtagaaaatctcaatgtattcccgtattactgagatggcttcatcccggttattaaaacgatagtggctcaggctctcatttttcagcgttccccagaagctttccatcggagcgttgtcgtaacagttacctttacgcgacattgatgttttcagaccaaactgctcctgtatgacccggtaatcgtatgcgcagtactgtgaacctcgatcagagtggtggattagcccggcaggtgggcgctggctcctgagcgccataaacagggctttacctgtcagctcttttgtcatgcgctctcccatggcgtagccgacaatttcgcacgtataaacatctttgatgccagtgaggtacaaccatccctcctgtgtggcaacatacgtcaggtccgccacccagacctgatttggtgctgtaggagcgaacgtctggttcagcagatttggcgcaactggcagattgtggttcgagttcgtagtcgctctgaacttgcgtttctgcttacagcgtagccttagctccttacgaagacgtgccagtcggtcacgaccaacgatgatgccattctctgccaactccgtctggagccgccgggttccatatgtttcgcgagtgcggatatgtgccaccttaatctccagttttagccgctcatcactttgttttatgtctgagggttcatgctgtacccagttgtaataaccgctcctggatacaccaaatacctgacacatcgcttcaatgggaaattgttgtcgccattgttcgattaacgcgtatttttcagcgactcctgtgcaaaatacgctgttgctttttttaatatatctcgctcaaggcgagcttcatttaacgccttacgcagttgcagaatttcagattccagttcagccaccgtgcgggaactaggagtaccgagcccttttctggcggcggtaacccattgtcctaaagtgccttcaggaagagataatcgggaagcgccttcactgatcgaaagttgattttcaagaaccgttctgacagcttcggctttgaactctttagagtaacgttgggtttttctgctcattattagctccttctgatgccattctatttcaggaaggagtgtccgttaaactcaggctacctcattggttcccactacttatttggtggacaccactttgtctaattcgtcagattctgaccagacggttcaggctgtacgcttacaaacaactagtggaaatacttgtactttataatttcaagggtacgggtccgcttcgtttgatttgcgtgtttttaacaattttaaaacccagacatactgttccggatgtggccccaccaaaatttccactgttttgttcatttgtcgggcaatcattttattgtccgcgctggcaatgcaagcatccattggtggccgaatttcaatagtcaggagatgttttttttcatcataaaccgggaaaagtggtataatcatagcctgactgatgttcatcagacgtccaatgattggtaatgtcgctttataggtcgcaaaaaaatcagcaaattcactgtattcaggaccatgatcctgatctgggaggtaatatccccagtatccctggcgtactgactgaataaatggttttatcccatcctcccgggcatgtaagcgccccccgaatttacgccgtactgaattccagacataatcaatcactggatttcgttgctgatgaaacatggcggccattttttttccctgagctgccagcaacattgcaggaatatccacgctccagccatggggaaccagaaaaatcacatttctattattgtgtcgaatttcctcaagaatttcgaggcctttccagaacactcgtttctggaacttttccggaccacgaattgccagttctgccatcatcactatggattgcaatgctgtggcaaacattttgtcgacaattatttcccgttctgtatcattcttttctgggaaacaaagcgataaattaatcgtcgccctgcgacgagcttttttgctcaatctgcccgcccaacgccctatttttgccaagacaggatctctgaatgaagggggaaacattgaaatacctgcaatcattcccaaaaggaaccatgtagaccagtaaacaggggaaaggtaatttttcttaaattcaggaataaactcagatttatattttttcattatttagtgcgaatgcctctaccaaaattatcattactgttttattcagaggatacatcaaaccttaatttaaattctgatgttctgagtgtacaggatatgcatccaaagagcggatagtagtttcatggatataatccagcaaagcgtatcgttttcggtactcagagcgttttttactggctatatcgcttagcggctttcgaatcacctgggttggtaatctgtaccagtcaccacaggtttttcctgctacagactcccagaaatcactatagaccgcaacaaaggttttgcgtttctgataccagtatctcaattgccggaaaacatgactgtgctcactgactgccagacactcagagatattgcaagctttcatcaacgcacaaaatgcttcaaaaataatccgttttgggaaaatcccataacaggcccgggttgcgcaccgaataacatcaggtccggtatttttaggggctccctgtaatccgccaataaaagcaatgtgtccattttgagtcagaatgactgaaaatgttaaccgggcaataactgttttattgtaaaacaatgacaacatcaactctccttcccggtcaaaaccactgggagaacactggatatcaaaattctctccatctttcccgatgaattggactaatgataccgatttttgtggaaacaaaaatttagaatatttttctggcaaattttgcacaaagcgataatgctcaagaatatattgtccacgggtccaggcgcgcccccctttatgcaaataagggcgatgaattcttgctggcaacgtggggtgtattgccagaatatcctcaatgcacggcaaggaacgcagttcataataatatcgaatactgacaaccggatttatagaacatcgcaaaatgtacatgaaccgaaattttctgtgttcccacttccccggtagtgaatctgaggaaaaaataatccttttaaggaaaccgataaatgataagttacttatagaaaacatattgttacttttgcttcgctaatgtgagtatttttaacgcagttttattaatatcaaaccgctcttctatatcctgttttgccaggcgagccatctgataaaaacgcccagggtcattaaaaaaattattcagggcgcacatccatgcgtgcttattacctgctggtaacaatgtcccggtctggttgttctgaataacctcagggattccaccaatctgagtggccactacaggcacagaaaatgccgatgcttctgccagcaccataccaaaagattcgttttctgaaggcagaaccaccagactggcaacccgatatacgggggcggcaggaaaaacattgtcagcaataaaaacatcatcatgcatgcccatactgtcaatctgatactgtaaatgttcccgcagttcaggtgaaccagaccccacaatcaaccaacagaactgtcgtccattcatttttaaatggaacagtaaattcaacataaattcgtgccctttttccgggcgcaacattcctacctgagcaattacggggcatcctcttcgggatgccagccaggaaagaacactcggaggcaaactgtttcgggaatcaacgtataattcctggaaatcaaagccaggaggcacaacagtaacccgagttcgacatccttcctgctccagatgtgtcttcatatttgttccgggaacaatcacctcatcgcaaaaatgatttattgaaaaaaattttgtttttcgtgtcaaatatgtcttttgcctgataattctgaatggatgtttccaggtaaaaaaccgtaccaaaccaacaatattactatcatgtccactgtgacaaacgattgcatcgggctgaaaactatgaactattccgagtaatctccatacagtaggaatgtgaagactgtttcgaaataacgcgaatgtgatatcaattccaaacttactggcttcaaaagcaattttgctgttctccctgcagacaagcagaactgaatgccccattttcttcagggccttcatttgagcaacagcctgtaattcctgaccacctatattcggtgatgattccgtaaatagtatattcattattagtcatccggtaatcttggccccttatgaagggccagcaacgatgaaaaaaacggtgttgtataataaaaaagtcgtcttttcagccatacgcaattttcccgttccttggtgcttattcttcctatccgtgtagttcctttagcaggagcattcattcttctttctgttgtatataaataatggaatccaagttcttcagcgatctgaatataatccttgttataataaccttccggccaacacaaatgtttactgcattttcctgtcattttttttaaatattctctcccgctcaataagtcctgccgaagatgtttacactgttcttctcgtgaagtgagctttttatcccaacgtgtatgagtatgtgtatgaacatgaaattcgaccagaccagattgcaacatttcgttcacttcagaccagcgaagcataacattatcagcattcccggttgctatttgatgttcgcaatcgcgatgagaatattcctttccaggagagtgacgaaccggaccatttccaataaaactggtaattaaaaaaatatgtgccttgagattaaactcgtttaataaaggatatacctgaaaccagttgtcaaggtatccatcatcaaatgtcaacataacgcttttacggggaagttttccgccccgataaaaaaactccagttcatctgatgacagtgttttccagttgttttcagccaaccatttcatttgtttccggaatgtctcgggagaaagtgtaaccagtcctgggcaatggctgacatgatgatacattaataccggaacatgatttgctttaaacaaaatgccccctccgtttaaaatttaaagtttctggcacccagtaagtagagataaaaggaaagcctaataaagttggtgagctttatatactactaaatcaaacatcaacaatttataaacaataatatattatcatatcttttaaaaacggctcactaagaaccttgaggtggcacactaaatttagctacctgaacagaggtgatatgctcacctcagaacaacacaggtgccataatgaaaaaagaaatttcagcgcagagtttaaacgcgaatccgctcaattggtcgttgaccagaaatacaccgtggcagatgcagccagcgctatggatgtcggcctttccacaatgacgcgatgggtgaaacaattacgtgatgagcggcagggaaaaacaccaaaaacctcccccattaccccggaacaaattgaaatccgtgagctcaggaaaaagctacaacgtattgaaatggaaaatgaaatattaaaaaggctaccgcgctcttgatgtcagactccctgaacagttttcgataatcgggaaactcagggcgcgttatcctgtggccactctctgccatgtgttcggggtccatcgcagcagctacaaatactggaaaaaccgtcctgaaaaaccagacggcagacgggttgtattacgtagccaggtacttgaactgcatggcatcagccacggctctgccggagcaagaagcatcgccacaatggcaacccagagaggctaccagatggggcactggcttgctggcagactcatgaaagagctggggctggtcagttgccagcagccgactcaccggtataagcgtggcggtcatgagcacgttgctatcccgaatcatcttgagcgacagttcgccgtaacggaaccaaatcaggtgtggtgcggtgatgtgacctatagtgtgcccggagttcagggcgggcatggatgcttaaatgaaccgcgagtctgtctggaatattgaaccggtaactcacgatgagaaacccaacaatcccaccgggtgtgacggtggagaacctgagcggcagtgacctgcggcatgcccgcagggtgatgtaacccgctgacaacggggattgaggcgagatcactaagccgagatgatcctcaaggttaagtactgaaaggctgaagaacatgaacccgttaatccgcctctgtgggttgaaaacgtcaccacggcctacgtgatctgacaggccgtgcaggaggaactggcagtgatacgtaagcactgccggtcgaaggtgttttgacatgtatgcgaaacaccggggcagcagcgtctatcacgcttgcgttgctgacttctgccaacttgcggcaagcaaggataaagagtgcgacgggcagcctcctcagtatgcctgagtccaggcaggtaaaccggggaaagtcagcgacggatgttaagggggcatggctccgatgacgcgctggctggcggagcttccgtagtagtccgcgatggggaaagcccattacatggcgaagggaagcagtttgaatgtgtttgcgacgtgaattaactgacctaacgaggtgaagacctttgataatcagcgaaatgcaacgcaagcttgccacatgggcagccaccgatccgtccctacggattcaacggctgctgcgtctgataacacaaccagaatggctggctgaagcggcgcggatcacgctttcatcaaagggggcgcatacccccggcgttgatggcgtgaacaaaacaatgctacaggccagactggctgttgagctgcaaatcctcagggatgaattactctcaggccactaccagcccttgcccgccagacgggtttacatccctaaaagcaacggcaaactgcgaccactgggtatccccgcgttgcgggatcgtattgttcagcgggccatgctgatggcgatggagccgatatgggagagtgattttcatacgctctcatatggcttccggcctgagcgcagtgtccaccacgcgatccgcacggtgaaattacagctcacagactgcggtgaaacccggggacgctgggtgattgaaggcgacctgtccagttacttcgacaccgtacatcatcgactgctgatgaaggctgtacgccgcaggatcagtgacgcacgtttcatgactctgctgtggaaaaccatcaaggcgggacatatcgatgtcggtctctttcgggcggccagtgaaggtgtgccacagggcggtgttatatcgccgctattatcgaacatcatgctgaatgagttcgatcaatacctgcatgagcgctacctgagcgggaaagccagaaaagatcggtggtactggaataacagtatccaacggggccgaagtacggcggtcagagaaaactggcagtggaaacccgcggtggcgtactgccgctatgccgatgattttgtcctcatcgtcaaaggcaccaaagcacaggcggaagccatcagggaggagtgtcggggtgtgctcgaaggcagtctgaaactcaggctgaacatggataagactaaaatcacccatgttaatgacggctttatctttctggggcacaggatcattcgcaaacgcagtcgttatggcgagatgcgagtggtctcaacgatcccgcaggagaaagccagaaacttcgccgcatcgctgacagcactgttatcaggcaactacagtgaaagcaaagtcgatatggctgaacaactcaaccgaaaactgaaaggctgggccatgttctatcagttcgttgattttaaggccaaagtcttcagttatatcgaccgtgtcgtgttctggaagctggctcactggctggccagcaaataccgtacaggtatcgcttccctgatgaggtggtggtgtaaatcaccgaaaccgggtcagagcaaaacgtgggttttatttggtaaaaccaatcacggcaagctcagcggcgaaatactgtaccggttggtggggcaaggcaagaagctgttccgctggcggctacccgaaggtaatccctatctgaggacggagaccagaaacacgtatacatcgcgctttacagaagtggcaatggcgttcgccagcatttaaatggagagccggatgcgctgaaaggtgcacgtccggttcggggaggagaggcagggaaatagtccgactacgccctgcctcttactctactctggacgggtaagcgctgggcgtacctcgccgttgttctcgacctgttcgcaagaaaaccagtgggctgggccatgtcgttctcgccggacagcaggcttaccatgaaagcactggaaatggcatgggaaacccgtggtaagcccgtcggggtgatgttccaggcgatcaaggcagtcattatacgagcaggcagttccggcagttactgtggcgataccggatcaggcagagtatgagtcggcgtggaaactgctgggataacagcccaatggagcgcttcttcaggagtctgaagaacgaatgggtgccagcgacgggctatgtaagcttcagcgatgcagctcacgcaataacggactatatcgttggatattacagcgcactaagaccgcacgaatataatggtgggttaccaccaaacgaatcagaaaaccgatactggaaaaactctaacgcggaggccagttttagttgaccacaacagactacctgaagggagccgcggtcgcctagcagttgcagtagcaggagatcatccagccgcagtacaggtcacgatgactctggttaatgataccggctttgaccccgtattttccggctctatcgctgaatcatggcgtcagcagccgtgcacaccatcctattgttgtgactgggaggctgccaccatgcttcgcgctttccctctggcgaaaaagggagaaggacgggcccgtctgccttcactttatgccagcttcggtaagctgggtgagacaccgactcatgaagatatcattgataacaatcgatccatcaactggcctgtataacgtggctgccggtgattaagaaagctgcacctacctaagtagtagcaaacgcacactttttagaaaaatcgatggtcagaaactggattagcaattccgttccagggttgcttttgatttacgttggcgtctgatcattgatttatcctcaaaagtccaacctcattggtaatgaaccagctccgtgaatgtccgctctggcacagagcgaaattttttgatctccccccctgaaatctaaacttagtcatgtcacgtttttgggtttctaaaattttaacttcgcgtttttcgttgccgtaagggttatacagaaatgtccgttaagcagagttcaaaattgattgccgtgatcacgactggtttgaaagccgcgcccaagcctgtacagctctggtttgcgttaattatgaacctgtcagcctaaagcaagcggatggacgatgagtattggtaatctttcagagtccggaaaagttcagccccagtctgaacaggcttgctggcgccagtccagtttcattcagtcgtggtttggttcttacggcctgtgcaatctacctcattaggcacatcggcctgccagataccggctcggggtgtatttccgcttccacgctgaatactgttctcagcaatcctggggtcatcacctcttctggtgtgccttgcgccataacatgtccgtttgccattaccaccagttgatcgcagtaccggctagcctgattaaggtcgtgcagcacagcgaccaccgttttcccctgagtccggagttcgcccatcaaccgcatcaggtccacctggtgattgatatcaagataggtggttggctcatcaagtaatacaacgggcgtattctgggccaggaccatcgccagaaatgcgcgctggcgctgaccgccggaaagctcggttaaccgacgaacggcaagatgattgatccgggtctggttcatggcgacattaactcgtgcattgtcttcagcggagagacgcccccagagtgacagccagggattacgaccatacgaaaccagctcctggactgtgatcccctctggcgttaaatggtgctgaggcagcagcgaaagcctgcgggccaactggcgcgatgagagcatatttatgggattatcgccgagaaatacggtgccagactgcggcattaaaagccgcgaaaaacagtttaacagcgtcgatttcccgcaaccgttaggaccgatcagggcggtgatcttccccgttggcagtgagagtgaaacgtcgttaagtaccttgtctgtcccgtaactgaccgtcagattttcagttcgtaaagtcatttatcgcattctcacaagcaaccagacaaaccacggcgcaccgataatggcggtcagcacgccaaccgggagctccagtgggggatgaataattctcgccagcagatcggcaaccaccaacagcaacgcacctgtcagggctgaaacaggcagcagtctgcggtgacgtccaccggtgatgctacgcatcatatgcggcaccacgagaccaataaagctaatcgggccgcaggcggccacgccggtagatgtcatggcgacagctagtaacaaagcccagaatcgggtatggggcaccgacacaccgagcgtggtggcgcgtgcatcgccgagtgcaaggaggtcgagatcgcggcaaaaactcaggctcagcggcagaaataaaatcatcagcgggatggcaatcttcacaaagctccagtcacggccccataagctgccggtcagccacagcagggcgttgttcacatcctgtgggcgcgagagcatcagataatccgtcaggctggcccagcatgcagaaagcgccacgccggtgagcgccagcttcatcggctggtgggtctttgccagcatcttcagtaatatcaaccccgccatgccgcccgcaaaggccagcagcggcagcaccatcacgggcagtgacggcataagaagtagagcccccacagaggccaggctggcggcatggttaacgccgagaatatccggtgatgccagagggttgcgcacaatcccctgtatcagcacgcccgccacggcgagggctgcaccgacaaacagtgccagcagcaagcgcggcagtcggtactccatcaatacataataatgctcgcgtccggcctgccagtcggtcagcagcgcgcgccacggcacggggatcactcccatatggagtgataacagcgcacagcccgccagggcaagggtgatgaaaataaccagcgcaattttcatcctcgcctcctcacaagccagacaaagcaagggctgccaatcagcgccagcactgcgcctgcgggcagatctccggggaaggccagcgcgcgtgcgagtacatctgccagcagcatcagcgtggcccccagcagcatgctcactggcagtacgttgcgctgatcgaagcctgcccagaagcgcgccagatgtggcaccagcagaccgataaacgccaccggacctgccacgctgacgcacgcaccaaccagaagcagcactaacatattgatgaccaaacgtagcctcgtcaggttcactcccagcgtatgggcggtgctgtcgctgaggttgagcaggttcagttgattcgccagcagcaacacgacagggactgcagtgaccaccaccggcaagagctgccagacatcctgccagcgggcgtgggacactccgcctgccagccagtaaaagatgccgtaagcatgatcttcggccagcagcagggtgatgcgggtaaggcccatacaaaaggccgacagcgcgatacccgcgaggatcagtttgtttctgtcatgggtatgacgaaatccgcctcctgcggtcatgaccagcagccagctcacgccgcccccgcatgccgcgatgaacgacagagaatagcctgcaatcggcgtcggacttagcgcgctggtaagcgccatagccagcgccgcgccgctgttaatgccgagcagtgaaggagaggccattgggttgtgggtcagggtttgcagcagcgtgcccgcgagcgccaggcttgcgccgatcagaacggcgaccaggcttcgtggcaaacgaaggttttgcaccagcgcttctggtagcgttggcgtgtgtccaggcagcagggcgcgggttgcatctgctccggaaacaggaatggccgagtagcaaaacagactcagccagaaaataataataagtgctgcaatgggaagcccccacagcagcaccgggtgttttatcgcggtcatttcacaacggtaagcggctgatggtggaagatttttaccgtgtcagcggcaatacgctctgcagcaaaaataccgcgcatccgcgcccaggtgttactgtcgaccgaagcaacctgctgcttctgcgcggcggttaacatctgccagagcggatcttgttgccagcgtttaacaatgctctcttcgcgatagtgggcaaccagcagccaggcaggattgaccgccagcagttgctccaggccgatggacggcatggacgcacccgccatcgcagcgggaacgttcagccccagagaggccagcacgctgccggtccaggtctcctgagtatgcaggttgaattgctgttcgcgtgatgtgccaaaggccacgcgtgtccctttgggaagctggctggcccactgcgccatcctctctttatgttgttccagacgtgcctgcatctctcgctttttacccaccatttcgccgatgatagccgcagattgcaaattttcagcgtaggtttcgttgcgggacttaagcagcagtaccggcgcgatttgctgcaaggcgatgtaaacccccgcatggcgactgctgtcggcaatgatcaggtctggtttcagagcggcaatggcttccaggctcggctgcgcgcgcgttccgacggactgccacggtttcaggtgcgcacgcacttcgggcaggatgcgttttgcatcgttatcgtcggcaataccgatcgggctgacgtccacggcggccagcgcatcggcgaacgagagttccagcaccacaatccgttgtggcgttttttcgagtgtaaacgtgccgtgttcgtcctgaaccatggcggcaaaggcgtggctgatcaccagcagcaggcctgcaaaaagaaaacggataaatgccaacataatcacattccagctaaaagcccggcaagccgggcgttaacacatcagaacttcaacgacccctgcatatacagcgtgcgcggctggcctgcatagatgcctttgttgttgtcgtcataagagcggatgaagtagtcctggtcgaagatgtttttcacaccgaatgccaggttcagatctgccatctgcgggccaaagtcatacgccacgcgtgcgccccagagcatgaagccgggaatgcggccggtactgccgtcggcgctctctttcaccgtattggcgttatccgcaaactggctggactggaaatcgctgttcagattgaacgtccagtttcctggcttgtagtccacgcccagcgtgcctttatgtttcggggagaatggtaccagattgccgtaggtgtcgcctttctcgcggatttccgcgttcacatacgcatagctggcgtagatggaaacgttatcaagcgttggcgttagcgtacccagatcgtaacgtgcctgcgtttccagcccggtatggcgcgttttgccacgtgcagtgacggtgtcgttggtctggttggagtcgtactgattgttaaagttaatcaggaacagccctatttccgccgtcagcgcgccgtcgtcgtagcgggtaccgagttcccaggttcgcgctttttccggttccacattgccgctttgcacagccttgccaatctggctgtactgtacggtgccgaacgagccttcagtgtttgcataaagattccagctgtcagtcaggtgatagagcacgttcaacgccggaagcggtgcgttatagctcacttcctcgtgcgtgcctgtgatggcgttgttctggtatgactcgatatgttcgaaacgcatacccggcgtgatggtccagttgccgatgtcgattttgtcatccagataccaggcgtgcgcctcggtgccggaacgcgtatcgcggtcgtaagggcttgagccggacggcaactgcccgctgctggtggcggtgtagtaacgcatttcatgcgttgattcattcaaatagcgatagcccacgcccacttcgtgcgcggaagggccgatcataaagatctggctgtagcgtggctcaataccgcgcacccagtagttacgcggcgagagggtgatgcgtttgccttgctccaggtagccgctgcgcagggtttgggtgtagaacccctgaatgttgaatttatgctggctgtctggctggaactggtagcccaggctcgccagcttgcgacgaccccagaagcggtcatacgggcgggtggattgccagcgatcggcgtcgtaatccgcgcgagacaggccaccgggcatgtcggcttcaccgtcgtaatattgcagcaggctgttgaaggtgtgcacctcatccggcgcatatttgcttttcagcatcaggtcgtcgatgcgggtggcgctgtgctcgcgccagtcactgccgcgcgtgccggagtagagcagcgcggtgccaaaaccgttgtccgctgtgccgcccaccatcaggttgtgcgtctctttcgggttgttttgtgaagaggttgggctgagctgaccttccacgcccgcctcgataccaaagtcctgcggaatggcacgggtaacaaagttcaccacgccgcccacgctctgcggtccgtaacgcaccgcaccaccaccgcgtaccacgtcaatggcatccatgttgccgagcgaaacgggagccagtgaaagctgcggctgaccgtaaggggcgaaggggacggggatgccgtccatcaggacggtcgagcggctggcgaggcgcgggctcaggccccggatgccaaagttcatcgccaggtcgtggctgccggtgccgttgttttccggcgcgctgacgccagggatgcggttaagtacctcacgcatggtggttgcgccggttttggcgaaatcctcacggcggatcacgtcacgcgcgccagcatgttcaaatacgtcgttttcacgcgcatcacccagccagtcgccgaccacggtcagggcatcttcttttggtgcgggcgcgggctccagcgtccagctgttatttcccagcggttttacctgcagtccgctgccgtccagcagttgttgcaggccgctctcgacgtcgtaatcgccgtgcaggccgttgctctgcttgccgcgcgtcaggctggcgtcaaccgagagggtaaatccgctgtgtgcggcatactgattgagcgctttatcgagcgatcccggtgcgatattaacctgtgcagcaaaagcggaaaacgagagaccggccagcggcagcaggctcaggcgaatggtgttaaccaaaggtgttgttttacgaaaaacgcgtaacggcgtcataccttccccatcatcatttttgttgtgttcagctatgagtcgaacgagaagggtaaaaaggacaatcgaaataagaattattttccttacagtggtgaaatgtttatccagtaccgcgtaatagactgaattttaacgggaagcgtttgcgcgataacgttcaggatcgcatcggtatttttcagcgggaacgtcccgctcaggcgcagcccggcaacggcgggatcgcagcgcagcacgccgttgcggtaacgggttagcgtggctatcacctcacccagcggtttatcgctgaagctcaggatgtccttcgtccagcttgtactctcgtcatccagcggtttcactgcgccaaactcagaggcgctgaactgcaggctttcaccagcgttcacgatgcgtttttgcgcgggggcactggcgagaagcacttccacagcgtgctgctgcacgtcaagctgcgtgaaattatcctgctggcggacggtaaattctgtccctaaagcagtgagctggccctgacgggtcaggacacggaaggggcgttgcagggcatctttcgcggtagtaatggcgatttcaccgtaccagagccggacggtgcgctgatgcgcatcaaaacgcacatccgccgcgctttgggtattcagcgtgagcagggagccatcttccagttgctgacggctgactgtgcctttggcggtgcggtaatctgcccgcagaccttcgccggtttccgactgccagagctgccagcctccgccagcgccgagcaacagcagtaatcctttcatcacgtgacggcgggtgaggcgggtatcgtgcaacgcccggctggtaacgtcgccaggcacaccgccaagctggttgcgcaggttttcaacctgctgccaggcccactggttatcctgatcctgttcataccactgttgccagcgcgcttcctgttgtgggctgacgcgctcgccgcttagaacggcataccagtgggaagctgaacgcagcgcctgacggcgggaatcggttaacaaaggattcataacccatactccagacggaacagcaggcagtgctcgatggctttcgccacgtattttttcacggagctgatggaaacaccgagtttgtgcgcaatctcgctgtatgtcagaccatccagttgcgaaagcagaaacgcttcacgtgttttgccgtttagcccgtccagcatgctgtcgaggagttgtagggtctcgagttggctttcgcgttcctcaggtgaaggcgctcccccctccggcataagcgccagcatctccagatacgctttttccagcgcgtttcggcgaaacaggtccaccatcacgcgtttggcgatagtgcacaggaaggagcgaggatcgcggatcgtcgagagcgtttcgctgaccattacccgcaaaaaagtgtcctgggcaatgtcatctgcatcaaaagcagactggagtttgcgcgtcagccagcttttcaaccagccgtgatgtgtgccataaagcgactcgaacgttaaggaagctgtggtagtggcgcggtcagacatgcggagtgcatcaaaagttaattatcacgtagccatattaatatgagaatggttatcattacaattggaaataaaattgtttccaatagacatttttaacatgttgtttttctaagtgttataaggtaggtataaaatgggatggagcatctgcttctggcatgtgtcggtcagaatgactcatgatgtggtctgctattattgacatcctcactgccctaaaggatggggatttcggtaatgctgtcaacttactgatttagtgtatgatggtgattttaaggtgcttgcgtggcttccatttccatcagatgtccttcctgctccgctactgaaggcgtggtgcgtaacggcaaaagcactgccggacatcagcgctatctctgctctcattgccgtaaaacatggcaactacagttcacttacaccgcctctcagcccggtacgcaccagaaaatcattgatatggccatgaatggcgtcggatgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacagtggggctacgtcggtgctaaatcacgtcagcgctggctgttttacgcgtatgacaggatacggaggactgttgtggcgcacgtcttcggtgaacgcactctggccacactggagcgtcttctgagcctgctgtcggcctttgaggtcgtggtatggatgacggatggctggccgctgtatgaatcacgcctgaagggaaagctacacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaagttggagtcattacctcctcccgaactcaaagctatcatacagataattactggttaaccctatatagggcattttaaagtgttgtgatcttacccagcaatagtggacacgcggctaagtgagtaaactctcagtcagaggtgactcacaagacaaaacagtttcaaccagtaaaaaaacgtaaacaccattcgcatgaatttcgtagttaagatctgaagcttgcagaatgcatcggtgttactgccggagtccgtgaacttagtctgcatgaatcaccacagctttacatctgtcgcagtaaacagcaaaatcagcaaacttacttaattatatcgagtgcgattacaatcgctggcgatggtacagttggtgtggcggtctcagtccggaacaatttgaaaatcagaatctcacttaaaacggcatccattttacaaaagatggccgtctgtgtatttgtaatgaataccttctacatgtttagagtgcataatccacgacaaggcgatatcctaaaaattagctagcaggcaactttgatggcatagataatgtttttagtaaaaaagagttgactgaatataatacagcctcttcctacataagaaggaatgtgctcacaaaaaaaaaccattagtctgcttcctgttcttacaataatcagtattatgtattttatttatatagcaaaatatgcttattacacctgtcataattaggcatggtaaaattattgactgaaccctgggggagaaagatgcacagtgattattataatatggtttttggtgaaaaattggccaatattttatatgaagctaactctcaatttttttacgagagaaatgtcatagaagaggcagtcaacgctttattctgtgagcgtgaaataataaacaacaagaacataataaagaagctgatgttctttttgtcagatgttaatcacaccaagaaagatgttgttcagagcgcacttaatattatcattgacattacatcaggtgatatttgagattttacataaaagataatctctcaaggagtcttatctgaaaacgaaatatatagtccctctcgttttgtaatatcgattggctttgttgaatcggttacgtaccccggagccggtcatattttcaggtaatacacacgctttcagacatttcggctttcgtcattttggtatcatgggcatagcttctgctacctgagcatcataatcacgcagcttcagtgaagcagtgaccacctgtttaacccggtgtatcgttatgatcttatccagcaataatggacacgcggctaagtgaaccaccccgggtttcctggagagtgttttatctgtgaactcaggctgccagatcatcgtttccgatggaagcataataagctttttctgcttctgccggtgggatatggccctgcctttccagcaatcgtcgattgttataccagtccacccacgtgagtgtggtcagctcatcatactgacacgtgcattacccctaccgcgataatgcaaccgtacaatatagggcgtttcctaaacgcagccctcatcactccaatccaacaagacacagcatttttgatcacgaagaaagacaaataatttccgtaaatgtttccgttgttacaaataacaacagtgttttacatttctttggcctcaggcccgcgcatgttgccattcgatgttattttcctgactcgtttcttctttatggtgtagtgtgatcttcactttatggatgctaacaatatgaaaagaaaaattattcccgtgctaatcggttgtacgctctctttctctgccctggcggcacaacctacggctgagcgctatgtcgtcagttttccagaaggcacgcacgtgaactacgccggcgcatttgccagtgcattcccgaacggccttccggttgggataggttctggcctgctgttcaccggtaaacagggcgatgccctgacattcgcaaccattaccgatcgcggtccgaacgcggattcaccgaaagaggggaaaaacgaaactaaaattttcgttacgccagatttcgcgccgctgctgatgacgattcgtgtacaaaacggcaaagcggaggccatcgatccccgtcctctgcatgacgataaaggtgcgatcaacggtctgccgctggcaagcgacgtgattggctccaccaatgaagtggccttcagcgacacgttacatagactgaagggggataatcacgggctggatacggaagggatcactccggatggtaaaggaggttactggctgtgcgatgagtatggcccgttcctgattaacatcgacagtaaagggaaaatcctggcaatccacggtccgcaggcggcggaaggggaaaaagcgattgcgggcggtttgccaaatatcctcaaatggcgtcaggcgaaccgcggctttgaaggcctcacccgtatgccggacgggcgtattattgtcgccgtgcaaagtacgctggatatcgacgctaagagcaagaaaaaggcgctgtttacgcgtctggtgagcttcgatccggcaagcggaaaaaccgcgatgtacggttatcctatcgacagcgcggcctacagcaaaaacagcgacgctaaaatcggagacatcgtggcgctcgataaccagcacatcctgctgatcgaacagggaagagataaaaacaacagaatgcgtaacctgatttacgaggtcgatctcaataaggcgagcgacctgtcaggcttcgacaagccgggtgagtatccggagtttgatgatgagaaaaccctgtcacagcgcggcattacccttgcgcagaaaacgcaggttgttgatctgcgctccttgggctggcagcaggagaaggctgaagggttggcgctgatcgacagcaaaacgctggcggtggcgaacgataacgactttggcgtgaaggtggcgatgcaacatccggtcgagggcaagacattcaaggattatcgggtgaacgcggaaggaaagctgacgcttgacgacaagcaggttgaaacgaccctcagagtgaagccactggagaaaccggagtctgacagtgaactgtggattgtgacgctgccggaagcgttgaaataagtttataaggtacggacagcagtatcgcttagtttttcaaattcatgtatgtgaacaatattggggttccggcgtagaccctcaatgaaagcgtcaccacgtgaaaacatgcctgcacggtttacacgtcatcccatggtggcagccggttaactttcctgctacaccagtggaaaaaggccataagcagtccgaacaaaagtaagcgtacagcgagggccgtattgacggggatgtgttattcagctggcagtgctatgcgctacggaagcagttcgctgacccggttgaccggccagtctgctatgacgccaagcacatggcgaaggtagctttctggatccacgtcattcagtttgcacgtcccgatcaggctgtacagtagcgctccccgctcaccaccatggccagagccgaagaacagggtcttcatcttttcacgcaaccagctttccagggatttcaacagcggtttcgtttttcgctgacgttcagcaagccgctgctctgccggcattccccttatatccgcctctatggcgtacaactgaccgatctgctccagggcttcttccgtcagtgctgacgggatgcggacgtgcacatcgtggatctttcagcgggcatgagcccagcaggcagcttccgttatcccaccattgcgatacagctcgttgaacccggcgtacgcatccgcttgcagcacaccgctgaagcaagcaagatgagtctgcggatggatgccttttctgtccgggctgtaagcgaacctcactgcaggtgccaacgctgacccggcattgcggtcatcacgaacatacgcccacaaccgcccggtcttcgtcttcttattacccggcagcagtacctggaccggggtatcatcggcatggagtttgccgtcagtcatgacatagccatgaagcgcctcttccagcggagacagcagccggcagcatgcatccacccagcccgacagcagtgaacggctcagctccacaccttgccggccgtatatttctgactggcgatacagcggggtgtgctctgcatacttcgaggtcagcacgtgggccagcagccccggtccggcgataccccgctcgatgggccgcgaaggtgcaggtgcctgcacgatggtatcgcactgagtacaggcatgtttttcccgtaccgtccggataacccggaaggcgctacgcatcaactccagctgttcggcggtatcctcgcccagatagctcagtgaaccgccgcagttcgggcagcacggcgccgcaggcaacagtcgcttttcgtcacggggtagtgattcagggaacggcttacgggtgcgggtctgacgcaacggacgctgtactgccgggtcatacaccctaccagtcagcgtatcgctctctttctgaagccggttcagatcggcttccatttgtgcgatacggcgggagactttttcggaacgactgccgaagttcatccggcggagtttatccagctgcgcctgcagatggtctatttcgcgctcccggttgctcagcttttcctgcagggcgtggatcagcgcttcctgttcggccaggcgctgtttcagcaggaagatgtcgtcagaagagatgtcgttcataagcccgtattttaccgggcttattctgtgacaaccaggataaagagatttacagcatggtcagggaggtcagcagccgcttgggctgtcgccagtcgataccttccagcagcatcgccatctgcgcctgcgtaaggaacactttgccatcacgggctgacggccaggcgaagcgcccacgctccagccgtttggtcaggaggcacagtccgtcaccggtggaccacagcagtttaacctgactgccgctgcggccccggaaaatgaaaatatggccggacatgggatcgtctttcagcgccgtctgtactttcgcagccaggccgttgaagctatttctcatatcggtgataccggcaaccagccaaattttggtcccggaaggtaacgggatcatcgcttcagttcctgtatcagcagagtcaggagcttttcgctgacattgccattgaagcggagcgtcccgtgccggaacgttacctcacagctgatactgagggtttccgggtcctctgcgagcgattctggctgttcggcagctgcatcgagagtcacaggaagtagctgggggctctctgaagaaggtaatagcagctttccctcgcgccattgttgtcgccatttgaacaacagattggcgttaatgccattttcaagagcaagttttgagatggatatcccgggttcacaggaggcagcaacgagcagctgtttaaattcgggaggataattagggcagccttttcgcctgccgggagtcacatttttctgcatatctgacactttggttcccactacttatttggtggacaccactttgtctaattcgtcagattctgaccagacggttcaggctgtacgcttaccactattttatccctgttgaatttggttaagccggtgcagacgcgccgggaaacgcacacctgaaccggcacaataaaatacaatacaaccccctgttactggagatacgaatggaatgacgaggcagcctgtcagtcacagggggctgttggcataaaatcaacggaaaggccaccaacaccggaattaagctccacagtccccgcactggcaatccattcccgggaaaggcatcaccgcaaactgctccggaggcaaccattacagcctctgtaacggattatcagccctggcatcttccgacggcacctcctgccgcccccacgccctgctgtataccccggtaccgcagcgtgggcagcacttttccccctcataattttcgtcacacatcacacaaaaccactttctcaccttcaccgtataatccggaaccgtcatgccctgcagatgcaaacgacgggcctctttctctgccgggtcaagccaggtacatcgcagcaggattttttcagcgacagtcatctggtcatgttcaaaccacggtggttgtccgtcattgccccgctgaagtgttaacgggcatccacaggacacacagcacaaaacgtcctgtcggttgtgcttcgcagcttctttcgccgtaacaaaatggcctttgctgtcattcgccatataacagttcagaattcgcatatttcctcctgagttgtccggggaatactgaatcctccggtctggcagtgtgtgcagtactgctccccataataatcgtggtgacattgtctgcagtgccagctggctttacgcaccacgggtaaggcatccggtacgaattgctgcagacgtttaatcaactgtatttctctgcgctccggcctgacataagggcactgttgaccgtgctctgtcagcctgtcgtcagtgtgttcaaaccagggaagttcagtgtcgtattgcggatggtatctgagtgcactgccacacaagtggcaggtgtagttagcataaggtgcggcctgtgcagtacgggcgcccgtcagacgtccgttgccatcaagagcgataaaggattttgcgtacatagtcatatacctcagccgccagacgacacgcaggcaacagccgtcccggtacgggcagcgtggtcagggtgtgaatggcggttcagttaaaatctggactggagtttgggtaaagcaggctggttgctgttacagcactgtggttgtcacacaatggaacactgacgtaaaaaacagtcagtgggcgagtggatacatcgttgccgccagacaacaacccatacttttggtttgccggatattggcgcgccagtcgtgctcaactccggctacagccaaaattgcgctcaccggtgcagtgagctttggtatgctccttcgccagatagtcagcacgttccagcacttgctgaaagccggtgtcatcattacgcgccagccacaccgccggccaggccggaaaatgcaccagcgtggcatggcacccgacatccactcccagggcactgcaccacgcctgtttaatcatcccggcgagagactccggagcgcggtaatcaccggcacgacaccaggtatcccggttgaccagcagcatcaggtgatagtgttttttacctttgcactccccaaactcccgggcccagacgtaatgcagggttgtgggatgcacgcgtttaccttcccgatgcttacgtttctggtaagcgtcgattcgggctttcagggcattgatgaagcgggatatcacagctgcgtccgttgctgccggtacatccgggagacgcaggtcaacccgcaatgccgtcaggcggggatgaacattcagtgcgtgccgcaccgtctcacgaatacgttgctgccagaaggggttgtatttgtaggtcatggttaaatctccgtatggttcatacggaatagccacgtcgtaaaaaatacgcagagtccctgaagtgacctccggcaggacactgtctcaggcactctgtgataacccgaacggtcgtctccggactgacggttgaattttcagcgttgttttttaatgtaaaaaaccggttacgggtaaggctgtgaggagggagtgatggtgatacgcaaaaagaagtgcagggactgtggaaacgcgattactcataatacagtgtgttgcccgtattgtggttctgtcgaccccttcggctactaccggaatacagaccgtatcgttaccatactgctggcgctgattattgtggtcctgctgactactgtcagcgtcagtgtgtgtatactgtgtagctggtgagataacggttcatgtatcccctgagctgacagtgtaccgtgtatattaagcgtaaccgacaggttctccttcataccatattaaattttccaggtattgccgctgccttatttcgtcccatacaggaaaactcatctgggtttctgacaaatacgcgaaactcacagcccctcaatatcaaccacacgttgtaagccggtaatacctgaaaatcagcctattaccgcccacgcctccggcaccattcccttttgatttcgaattctttgttgccgttatactgcttaatgttcccgatcttccggtgcacagataacaccggagtcatcgtagcgcggattcaagattcaggtgacatatttccagacggaagccggcacgcgatcgtaaagtttgttcattgtcagttctgccagccggtgatcgaccgcagagttaaaggccagttccgcaggggtaagtttataacgtgtgtgggaaatcactttttccagcgtctcccgggatgaacaacgacggaactgatacagccagtcttctttggttttaacttccattagcctctcatcactttatgctgcaattaacgtgatactgccagcataccgcacctgactggcattctggtacccaccccaaactcattactcccgcaccaccacttaaccggtctctcagactgtcactcaccaggtcggatacgtttaccgctcagacggatgcttaatgcactctgttcacgtgtgttgcaggtacgttttatatacgcaggttatacgccagctatcagggatagccctgtgagtacaacgtaatctgttgctactgcgttctcatacccactgatcacactcacagtgtttatttcacagatatgaactcatgtgtttgatctctcttatatatttataataccaatcagacagtcttatcccatcggtgatacctgtccctgcccacaaggcacgagctgccccaccgtaaccgccccgtaaataactctgcaattataagaacgacggttcttcccctcatcctcccgaaaatcatcccttctctgtcgtgcgtacgcgcgagaaacatcgtttcgcggtagccaccgggtatcccagcatcatgctccctgtttatctcccgacaggaatattcccctgctcattttttacgtttctccccggttgttatgccagtgaaggtggtgcgttgttttcatcaccaacgccggttgagattaacaacatccggaggaacattttcatgaataccccagtttcgctgatggatgaccagatggtcgacatggcgtttatcactcaactgaccggcttaaccgataagtggttttacaagctcatcaaggatggtgcctttccggcccccatcaaactcggccgcagctcccgatggctgaaaagtgaagtggaagcctggttgcaggcgcgtattgcacaatcccgtccgtaattcctgaccattacccgttcaaccgcagcgaatacactatccggcctccggaggcattttgctgcgtgctaaaggagagaatattatgcaaaaacttgaaaaccggtgtgatctgctgctcacccagcatcagaaatggatggcaagtgtaacccggtttattgtcgctcacggaatgggctctccgcatcttcatggttatcatcgcctgaccctggcccacttttttctgccggaaaaaggcaccatcatctcggtggcaccacagggactctatcaggtagtcaacccggcaacgccaccgttcattcctgccattcaggaagggttaatgaccagcattcagactcatgaaatcatgttacttacacattttaacctgggtggtgttttactcagtgaactacatcgtctgggagaaagccgactggcaaacaggctgaacagtctgctccggcgttttgacgatcgcgatctctaccacaccctgatatggctgtgctggtatgatctgatgtgcgcccactccatgcagccctggactgaagagttaaaacataaatcacacgcagaacttgaaagctggactgtggcgcgcaaacgggaaaagcgcgagcttgaactgatgattgacgagtacctgttatacgcctgttgattcataatcactcccgggcggtacgtagtcagtgataccggaatttccggagagggtcgcaggtatattgtttctgtgcaattcatggttattcacgttggatgtagtgattgctgcatccaatgctatcggaaagagattaaccagcaaatggttcctcaaatcgtattgatatttacccggcgcattgagcaccaccatctgcccccgttcccacatcaaacggctggaccggaaaacgatttgcttttcatgctccgtggaaattcacgaaaaagttattgggtcattcatcgaaaaaaacatattctgctgactggagtcatcacccagaaataaacgtcaactgaacaataacgattttttctttgtgggattccatacacttttccatccccctctgaaaattagtcatcaactcaccaacacatcttctgaaatttgtattaaacttattgcttaaatagatgatataatatctcttccattgcacggaatcagcaaaaactgtcattctggcaatcttaacaagaacatttatcggttaattttatcagtaaacaatggaatatcatactgataaaatgaacattcagggtaagatgatgaaattcacatgaaaaatgctgaagattatttatttcatgcagataaacgataaaaaacaagagagtatatttttcagtgtaagagtcaactgttcatctccactgacgatcacggtcagcatacaaacaaagtgagtcctcctgcttagtcattgcgtatcagaaactaaaaaacaaaagattctgcaaacaacgtgacattttttatgacatttcccgaatacatgtatatcaataaacggtagtcatcgttgaattaataagtcttacagagctatacgtagcttataaaaccactcaacgaccatcatcacctgactatttagcgggagtatcgtctgtataaatccataaataataacacctgttattaaaataagaatgctgtcagccgtaaactattaacacaacacctgtccactctatctgttcttttaactcaaccggcgtcgaaaatatttcctgattagtgcatcatagtcttcttttttctttcccgttcattaaaacaaatacaacatttacaaccacacaataaaacaaaactaaaacataagattaacaacaccaatcaacaggaaaacactgaatattgaggtgccctataacctggagagcgcatacggcgcatgtgatcaacacagcccattcttttctgtcatcccccaaatgcagaacaaacaagcataaccaaatgaatataaaagaaaatattatttttcaccatcataaaaacatcaatgtatctttatataaaaacactgataacatgacatagacatttaaaaacataaacaaatcacaacaaaaacatttgataatcacttagtgacaaaataaaattgagacgattttgttataagagaggcgacatggagtgagataatgaataacgaacagatgcttatcaaatgcaaagatccccgtaaatgtcggttttatgccgaatatctgaatcacaaataccccaatgaattccctcagtttgcgcctgacaacccacaaaactgtatcagaaatgttaattcgtttttaaaagaaaagtattataaagcttcaaacaattcttttggtgtttttggttcgactgcagaagaagctctcagcaaagaaattaatgaacttgaaattattgcagggcaggcaatactgcctgaagagagttttctctggttgaaaactgacgaacttgcgactttctttacctggactactatttatctgtcgaaggaagaccatacaaaattcccgaaaataaaccataattcatcaggaataaaaaacggaattgaagtcaggaaaatacgaacagttaccgatgaaacgttaaatacttacaaaaaaagtaaccttccggataatccatcatcccataacgaacgaataaaagtaatcatttcatattttgactcctgccattctttaattaataaaaatgcaaaaagcatatacctcgaggaactcagacaggcgtggcttaaaaagaaaagcgcttgtcaaaagtttaagtggctccttcctgacgatgatgaaatgtgtcagtggttctggacaagactgaaacaaaaacaggatgaaaaacatccagtacataacccagtgacccggtggttcataccatcttcaacgaaagaatattatcttgcctctcttgtcgcctttgctttatggaaagaagcgcctgataccattgaactgttcagaacacgaataaatcatgcctggcatcagaaaaaacaaaaggacaaatatcggagtgatggtaaaaaggccattaatatacatataagaagcaatgtgaaagaaatgcttgatgagctcagaactgtttacggtctgagaacaggagagttttttgaaatgctgattacagagaaatatcttgaacacaagcgaaggaagtaattcattacctgttacattctaaataatctcagacagatattatctccgtgaatcccccgccacctttccggtgcgcggggttttgtcttttttcaccgggaatacatgtatgaatccgtctgatgccattgaggcaattgaaaaaccgctctcctccctgccttactcgctttcccgtcacatcctggaacatctgcgcaaactcacccgtcacgagcccgtgattggcattatgggtaaaagcggggccggtaaatcttcactctgtaatgccctgtttcagggggagatcacaccggtcagtgatgttcacgccggcacccgggaagtgcagcgcttccgtctgagtggtcacggttacagcatggttatcactgacctgcccggggtgggcgagagccgggacagggatgcagagtatgaagccctgtaccgtgacattctgcctgaactggacctggtgctgtggctgattaaagccgatgaccgggccctgtctgtggatgagtatttctggcgacacatcctgcagtgcggacatcagcaggtgctgtttgtggtgacacaggccgacaaaacggagccctgccatgaatgggatatggccggcattcagccctctcccgcacaggcacagaacattcgcgaaaaaacggaggcggtattccgtctgttccggcctgtacatccggttgtggccgtatcggcccgcaccggctgggaactggatacgctggtcagtgcgctcatgacagcgcttcccgaccatgccgccagtcccctgatgacccgcctgcaggacgagctgcgcacggaatctgtccgcgctcaggcccgtgagcagtttaccggtgcggtggaccggatatttgacacagcggagagcgtctgtgttgcctctgttgcacgcacggttctgcgtgccgtccgtgacacagtggtctctgttgcccgcgcggtatggaactggatcttcttctgaacctgttgtggatgatgtcctccctgcctctgagtctgctcacaaaagcgctgttttcgttactgtctctcttgtccgtgcaatagctcaataatagaataaaacgatcgatacctattttattgatcgtttatatcgatcgataaactaataataacctttgtcagtaacatgcacagatacgtacagaaagacattcagggaacaacagagccactcgtcagaaacttccgtcagccggacctctggcactgtaaccctttacctgccggtatccacatctgtggataccggcttttttattcactctcactctgattaaggaaatgctgatgaaacgacatctgaatacctgctacaggctggtatggaatcacattacgggcgctttcgtggttgtctccgaactggcccgcacacggggtaaacgtggcggtgtggcggttgcactgtctcttgccgcggtcacgtcactcccggtgctgtctgctgacatcgttgtgcacccgggtgaaacagtgaatggcggaacactggtaaaccatgacaaccagtttgtatccggaacagctaatggcgtgactgtcagtaccgggcttgagctggggccggacagtgacgaaaacaccggcgggcaatggataaaagcgggtggcacaggcagaaacaccactgtcaccgcaaatggtcgtcagattgtgcaggcaggaggaactgccagtgatacggttattcgtgatggcggagggcagagccttaacggactggcggtgaacaccacgctggataacagaggtgagcagtgggtacacggggaagggaaagctaccggtacaattattaaccaggatggttaccagaccataaaacatggcggactggcaaccggaaccatcgtcaacaccggtgcagaaggtggtccggagtctgaaaatgtgtccactggtcagatggtcggggggactgctgaatccaccaccatcaacaacaatggccgacaggttatctggtcttcgggggtatcccgggacactctcatttacacaggcggtgaccagacggtacacggagaggcacataatacccggctggagggaggaaaccagtatgtgcacaaatacggacttgcgctgaacacggtaattaacgaggggggctggcaggttgttaaggcaggtggtactgccggtaacaccaccataaatcagaacggcgagctgaaggttcatgccggcggagaagcgtctgatgtcacccagaacacgggcggtgcactggttaccagtacagctgcaaccgtcaccggcacaaaccgcctgggagcattctccgttgtggcgggtaaggctgataatgtcgtactggaaaatggcggacgtctggatgtgctgagcggacacacagccactaatacccgtgtggatgatggcggaacgctggatgtccgcaacggtggtgccgccaccaccgtatccatggggaatggcggtgtactgctggccgattccggggccgctgtcagtggtacccggagcgacggaacggcattccgtatcggaggcggtcaggcggatgccctgatgctggaaaaaggcagttcattcacgctgaacgccggtgatacggccacggataccacggtaaatggcggactactcactgccagagggggctcgctggcgggcaccaccacgctgaataacggtgccacgcttaccctttccgggaaaacggtgaataacgataccctgaccatccgtgaaggtgatgcactcctgcagggaggcactcttaccggtaacggcagggtggaaaaatcaggaagtggcacactcactgtcagcaacaccacactcacccagaaaaccgtcaacctgaatgaaggcacgctgacgctgaacgacagtaccgtcaccacggatgtcattgctcagcgcggtacaaccctgaagctgaccggcagcacagtgctgaacggtgccattgaccccacgaatgtcaccctgacatccggtgccacctggaatatccccgataacgccacggttcagtcggtggtggatgacctcagccatgccggacagattcatttcacctccgcccgcacagggaagttcgttccgacaactctgcaggtgaaaaacctgaacgggcagaatggcaccatcagcctgcgtgtacgcccggatatggcgcagaacaatgctgacagactggtcattgacggtggcagggcaaccggaaaaaccatcctgaatctggtgaacgccggcaacagtggtacggggctggcgaccaccggtaagggtattcaggtggttgaggccattaacggtgccaccacggaggaaggggcttttgtccaggggaatatgctgcaggccggggcctttaactacaccctcaaccgggacagtgatgagagctggtatctgcgcagtgaagaacgttatcgtgctgaagtccccctgtacgcctccatgctgacacaggcaatggactatgaccggattctggcaggctcacgcagccatcagaccggtgtaaacggtgaaaataacagcgtccgtctcagcattcagggcggccatctcggtcacgataacaacggcggtattgcccgtggggccacgccggaaagcagcggcagctatggcttcgtccgtctggagggtgacctgctcagaacagaggtcgccggtatgtcactgacgacaggagtgtatggtgctgcaggccattcttccgttgatgttaaggatgatgacggctcccgcgccggtacggtccgggatgatgccggcagcctgggtggatacctgaatctgacacatacatcctccggcctgtgggctgacattgtggcacagggaacccgccacagcatgaaagcatcatcggacaataacgacttccgcgcccggggccggggctggctgggttcactggaaaccggtctgcccttcagtatcactgacaacctgatgctggagccacgactgcagtacacctggcaggggctctccctggatgacggtaaggacaacgccggttatgtgaagttcgggcatggcagtgcacaacatgtgcgtgccggtttccgcctgggcagccacaacgatatgacctttggtgaaggcacctcatcccgtgacaccctgcgcgacagtgcaaaacacagtgtgcgtgaactgccggtgaactggtgggtacagccttctgttatccgcaccttcagttcccggggggacatgagcatgggtacagccgcagccggcagtaacatgacgttctcaccgtcacagaatggtacgtcactggacctgcaggccggactggaagcccgtgtccgggaaaacatcaccctgggcgttcaggccggttatgcccacagcatcaacggcagcagcgctgaaggttataacagtcaggccacgctgaatgtgaccttctgataattctgcattgcctctctgtggtcccggtcatcatgaccgggacccggacgggggaaaacgtttcagtgccacattcactggcattcacaataacatgatattcatcacggagtgactatgttacagatagtcggcgcgctgattctgctgatcgcaggatttgccattcttcgccttttgttcagagcattaaccagcacagcgtctgcgctggcagggttcatattgctgtgtctgttcggtccggctttactggctggctatatcactgaacgcataacccggttattccatattcgctggctggcaggcatatttctgacgattgccggaatgatcatcagcttcatgtggggacttgatggtaaacatatcgcactggaggctcatacttttgactctgtaaaatttattctgaccaccgctctcgccgctggtctgctggttcttcccgtgcagataagaaccattcagcagagcgggctcacacctgaagatatcagcaaggaaattaacgggtattactgctgtttttatactgcttttttccttatggcgtgttctgcatacgcaccattgatcgcattgcagttcgatatttcaccctcactgatgtggtggggcgggttgttgtactggctggctgcattagtgacgctgctatgggcggccagccagatccaggcgctgaaaagactgaccagtgccatcagccagacactggaagaacaaccggtgctcaacagtaaatcgtggctgagcagtttgcaaaacgattacagccttcctgaaacgctgacggagcgcatctggctgacactcatttcacaacggatttcccggggagaactgagggaatttgaactggcagacggaaactggctactggacaatgcctggtatgaaagaaacatggcagggtttaacgaacagttgaaagagaacctgtcattcacacctgatgaactgaaaacgctcttccggaaccgcctgaatttatcaccggaagcgaatgacgattttctcgatcgttgcctggacggcggtgactggtaccccttttcagaaggccgccgttttgtatcattccaccacgtggatgagcttcgtatctgtgcctcctgcgggctgacagaagtacatcatgccccggaaaatcataagccggatccggaatggtactgctcctctctttgtcgcgaaacagaaacactgtgtcaggacatttctgaacgttcttacaccggttttatttccgatgcaacggcgaatggtctgattctcatgaaactgccggaaacctggagtacaaatgagaaaatgtttgcttccggagggcagggacatgggtttgccgctgaacggggaaaccatattgtcgacagagtccgtctgaaaaacgcacggatcctcggtgataataatgccagaaatggagcagacagactggtcagcggaacagaaatccagacgaaatattgttcaactgcagcccgtagcgtcggtgcggcattcgacggacaaaacggacagtatcgttacatgggaaatcatggtcccatgcaactggaagtcccccgtgatcagtatgccggcgctgtggaaaccatgaagaataagatccgcgaaggtaaagtacccggtgtaaccgatcccgcagaagcgtcccggctgattcgtcggggacatctgacttatacccaggcccgtaatatcacccggttcgggaccatcgaatcggtcacttatgatattgccgaggggtcggttatcagtctggcggccggagggatcagttttgccctgacggcatcggtcttctggctcagcaccggcgatcgcgatgctgccctgcagacagctgctgtccaggcaggaaaaaccttcacccgcacactggctgtctacgtcacaacccagcaactccaccggctcagtgttgttcagggtatgctgaagcacattgatttttcgactgccagcccgactgtccgactggctcttcagaaggggaccggtgcaggaaatatcagtgccctgaacaaagtaatgaagggtacgctggtgacatctctggcactggtagctgtcacaaccggccctgacatgatcaaaatgttgcggggacggatctccggtgcgcagttcatcaggaatcttgccgtggcatcttccggtgtggcaggtggtgctgtcgggtcagtggcgggcggaatactgttcagtccactgggaccatttggtgcactgacagggcgtgtggttggcggtgttctggggggaatgattgcctccgctgtatcaggaaaaattgccggagcgctggttgaagaagatcgcgtcaaaattctgacaatgattcaggagcaggtgacatggcttgccggcagtttcctgctgaccggacatgagattgaaaatctgaacgagaatctggcccgtgttatcgatcagaatgctctggagatcattttcgccgccggtatacaacaacgggccgcgaccaatatgttaatcaaaccactggtggtcagtatcatcaggcaacgccccgtcatggaatatgatgcatcccatctcggcaatatggttaaccgactggaagaagcattccccccggagttaccggcataacggctattctgcgccttttacgttttatcacctgatttgtcagtgtcatcgtcatgactcagagaggtaaataccatgattcacctgttcaaaacctgcatgattaccgccttcattctggggttaacgtggtctgccccactccgggcacaggatcaacgttacatcagtatacgcaatacagatacgatatggctcccgggaaatatttgtgcctaccagttccggctggataatggcggaaacgatgaaggatttggccccctcaccatcactctgcaactcaaagacaaatatggtcagacgctggtgaccagaaaaatggaaacggaagcctttggtgacagtaatgccacgcgaaccacagacgcatttctggaaacggagtgcgtggaaaatgtcgccacaaccgaaatcattaaagcaactgaagaaagtaacggccatcgtgtcagtctgccgttatcggttttcgatccccaggactaccatccactgctgattaccgtttccggaaaaaacgttaactgatccctgaagtcagtttcatgcttcagcctctgtcacaacgcgtggcagaggctttttatttatcaggagaaaacagatatgccgggttacacagagtatgtcctggctgaaggatctttctcatacgggcaggcggttgctgtcataaccgcttaccgcaatgtgtttatccaggatgacccgggaatgcattttcgtcgggttatccgcaacgcggaaggtcagcgacgctgacgcagccggaactctgaagctgatgccggaaaacagcttaatgcgtggctcgccagtggagggcttctcagacaataaacctcattgatttcatccatcaggccgcgtcttctccgggagacgcggcttttttcatttattacaccagtaaatcttaaccaccgataaggagcaaagtatgcgattagccagtcgttttggttatgctgcaaaccagatacgtcgtgaccgcccactgacacatgaagagctgatgcaccatgtgccggggattttcggggaagataaacacacgtcccgaagccagaactatacgtacatccccactatcaccgtactggaaagcctgcagcgggaaggttttcagccctttttcgcctgccagacccgtgtgcgcgacccgggccgccggggatacacaaaacacatgctgcgtctgcggcgggccggagagataaacggagaacatgtccctgaaattattctgctcaactctcatgacggtacctccagctaccagatgctgccgggttacttcaggttcgtctgccagaacggatgcgtctgtggtcagtctctgggggaagtgcgtgttccgcaccggggaaatgtggtggacagagtcattgaaggggcttacgaggtggtgggcgtgtttgaccggattgaggaaaagcgtgatgccatgcagtcgctgattctgccgccaccggcacgccaggcgctggcacaggcggcactgacttaccgttatggtgacgaacatcagcccgtcaccaccgccgacattctgacgccacgacgccgggaggattacggtaaggacctgtggagtgcttatcagaccattcaggagaatatgctgaaaggcggaatttcaggtcgcagcgctaaaggaaaacgtatccatacccgtgccattcacagcattgacactgacattaagctcaaccgcgcattgtgggtgatggcggaaaccctgctggagagcctgcgctgattcagccattaccctgaaaaccacgcatttatttgtcctttaaggagtcatttcatgaaaaccatttcacataattccaccacatcttctgtttccgtaaccgctgcatcagggaatgaccagcctcagttggttgccaccctcgtccctgatgaacagcgcatcagcttctggccgcagcactttggcctcattccacagtgggtgaccctggagccccgtgtcttcggctggatggaccgtctgtgtgaagactactgcggtggtatctggaatctgtacaccctgaacaacggcggggcatttatggcacccgaaccggatgacgatgatgacgaaacatgggtactgttcaatgccatgaacggtaaccgcgctgaaatgagtccggaagctgccggcattgctgcctgtctgatgacgtacagtcatcatgcctgtcgtacggagtgttatgccatgacggtccattattaccggttgcgggattacgccctgcagcatccggaatgcagcgccattatgcgcatcatcgactgaatggaggcagggacaatgcaacagctttcctttctgcccggagagatgacacccggtgagcgcagcctcattcaacgggccctgaaaaccctgggccgccatcttcatgaacccggcgtggccttcacctccacgcatgcggcacgggaatggctgattctgaacatggcgggactggagcgtgaagagttccgggtgctgtatctgaataaccagaatcagctgattgccggtgaaaccctcttcaccggcaccatcaaccgtacggaagtccatccccgggaagtgattaaacgcgccctgtaccacaatgccgctgccgtggtgctggcgcacaatcacccgtccggtgaagtcacccccagcaaggcagaccgccttatcactgagcgtctggtacaggcactggccctggttgatatccgggtaccggaccatctgatagtcggtggcagccaggttttctcctttgccgaacatggtctgctttaacccgtcacaaccacatcacacctgttttcacttttatcttctgtcttcagaggtatcccattatgaaaattatcacccgtggtgaagccatgcgtattcaccaacagtaccctgcatcccgtctttttccgttctgcaccggtaagtaccgctggcacggcagcactgaagcgtataccggtcgtgaggtgcaggatattcccggtgtgctggccgtgtttgctgaacgccgtaaggacagttttggcccgtatgtccggctgatgagcgtcaccctgaactgatgttccgtcacccggaaaacgagtacgactggctgagctcagacgccgctgtggatgaggtcctgctcatcaacgaatacacctttaccgaagccggtctgcgcgccggctgacccgtcatcgttaaactatcattcaccgattttctgtgaggattttatcgtgtcagacacactttccgggacaacgcatcccgatgacaatgacgaccatccctggtggggactaccctgcaccgtgacgccctgtttcggggcacgtctggtgcaggagggtaaccgcctgcattaccttgccgaccgcgccggtatcagaggcctgttcagcgatgcagatgcgtaccacctggaccaggcctttccgctgctgatgaaacaactggaactcatgctcaccagcggtgaactgaatccccgccatcagcataccgtcacgctgtatgcaaaaggtctgacctgcaaagctgacactctcggtagcggtggttacgtttatctggctgtttatccgacgcccgaaacgaaaaagtaaaccaccggaataaccttctgctccggcctggtgctttcaccacgccacttttccatttttcatctctgcatatcaggaaaaccttcagtatgaaaacattacccgatacacacgtacgggaggcatcgagctgcccgtctcccgtcaccatctggcagactctgctctcccgactactgggccagcattacggccttacactgaatgacacaccgttcgccgatgaacgtgtgattgagcagcatattgaagctggcatttcactgtgtgatgcggtgaattttctcgtggaaaaatacgcgctggtgcgtaccgaccagccgggattcagcacttgtccccgctctcagttaataaacagtattgatatcctccgggctcgccgggcgaccggcctgatgacccgcgacaattacagaacggtaaataacattaccctgggtaagcatccggagaaacgatgaaactttccctgatgctggaagccgacagaattaatgtgcaggcactgaacatggggcgaattgtcgttgacgtcgatggtgttaatctcactgaactgattaacaaggtcgctgaaaacggttattcactccgcgtggtggaggaatccgaccaacagtcaacctgcacactaccaccgtttgcaacccttgccggcatacgctgcagtaccgcacatatcacggaaaaggataacgcctggctgtactcgctgtcgcatcagaccagtgacgttggtgaatcagaatggattcatttcacaggtagcggatatctgttacgtaccgatgcgtggtcatatccggttctgcggcttaaacgcctggggctgtcaaaaacgttccgtcgtctggttatcacacttacccgacgttatggcgtcagtctcattcatctggatgccagcgctgaatgcctgccgggtttacccactttcaactggtaaccaggaacaacatgaaatcattaaccacggaaaccgcactggatattctgattgcgtggctgcaggacaatatcgactgcgaatcgggaattatctttgacaacaatgaggataaaacggattcagcagcactgttgccctgtatcgaacaggccagagaggatatccgtaccctgcgccaactgcagcttcagcaccagaaccggtgagtcttactcaccagacttcattccactgacgccagcctgaacagggctggcattttcatttatctgcaaaaaggaatatcgattatgtctgatatcacagcctaccgtccggaagtggtcaacgagaatacggacgttatctgctcaaccagcatccgccgcattctggctgtacgaaagagttcactgctgcaaatcgacacaattatccggcatcaagtgagcgatatcagttaacagatatagatggagaagatgcttttatccggattggttctatcgcgatggtgcgagtactacttgatgcaatgaagcctgtcgaggaagatgacgagtaacagagctcggtatctcaatcaggagctgattgtcctggttcgatgccgaaaaccagtgatttttcgtgttggtatctgtgttggtataagatgatattgtttattattaacaattttaaatcatgaggttaagtcacatgtttgagtccggccttcgcaccaatcaaggctttttcagtctacttgtgtatataaatcaataagttagataatatccctcttgtttcagctccattaaagtctactgtcgtatatcaatatctatcaataaatgttggtataactcttggtggcttctgttcgatttatattgatgccaacatagcgagggggatgtatggctcttactgatatcaaagtcagaacggttaagcctgcagacaaatctttcaaacttaccgatgatgagggggatgcacctgctggttaaactaaccccaatggcccaaaatactagcgtcttcaataccgtttaagtggcaaacagaagatgctggcgttagggggttatctatggcctcattggcagaggcttgtaagaggcacgatgcagcaaagaaactggtatctgatggcatcgatccctctcaaaagaaaaagaggaaaagattgcagaaagcggagcgctaacctttgaggctgtggtaagagattggcaggcatcctgtagtaaaaaatggtcggagccccatagtgaacgagtgcttaaaatcttagtggataatcttttcctggcgttaagtaaacgtaaaatttcggaactgaagacacggggtctactcgtctttataaagatagttgaggtgagcggacgttatgaagttgtctaacgtcttcaacaaaatacaactgctatcatgcatttcgcgttacaaaatggtctgattgattataacccggcccaagacatagctggtgcggtagccgtggctaaacgagtggatcgtccagggtttgattaagaacgtcttcccgaatggcttgatcgcatcgaatgctttaaaggtcgaaagtttactaaattggcagtgaaactcatactgctggtattcatacgtttaggtgaactgcgttttacaagatgggaagaaatcgattttaaaaatgcactttggacgatacctgcacaacgagaacctctgaaggcgtaaagcacgcacattgtggttctaagatgcgtagtccttatcttgtactatgaagtcgtcaggcactggaaatgttaggagagataaaacaaaccagtggtcttcataggcgttcaccagccggttaggcagatgagtgagaacacggttaataaggccctgcgcttaatgggctacgagattacaacggaagtttgtggacatggggttagggcgatggcctgtagtgcgttgaagtggcagaagctaatgaactgttaaaaatagagaaagatgagttttataggaactaccttgaaaaaactattaaggatatatcttctgttcatggtggttatttttcaaaagataatagtgataaagatgataaaattgagcaggaaatcaacgaaatccttcatgacaaagagcttttattgtctttagaaaatcctcgccgtttcattttctctaaatggacgttgcgtgaagggtgggataacccaaatgtttttcagatctgtaagctccgttcgagcggtagcaccacatctaaacttcaagaggtagggcgtggtttacgtcttccagtgaatgaatacatgtgtcgtgtgaaagaccgcaattttaccctcaactattatgttgattttacagaaaaagattttgtcgattctcttgtcaaagagatcaacgatagttctttcaaagagactgttccaagtaagtttactcaagagcttaaggataaaatcctatctcaatatccagagctttcatccagaacactcatgaatgaaatttttgatgatgagatcatagatgataatgataacttcaaagattcagatgcctatagccgcttaaaagccaaatatccggcagcatttcctacaggagtgaaaccaagcaaaatcaaaaaagccactgatggaaaaagacgcactaaaattcgtgttggtaagttcagtgagctgaaagaactatgggatttgatcaatcaaaaagcagttattgagtataaaataaatagcgaaaatgaattcttatccattttcaagtcattcatgctcgaagaaacagaaagatttactaaatcaggcgttcatactcgcattgataaaatttatatctataatgatacggcaatgtcgaaaagcattatcagtggtgatgataactttgctaaactaaacacaatgagctatcgggaatttcttgataacttatcacaaactatttttgctaaacacgataccttacataaggttttttgtgatataaaagaaactattaatatcactgaatacctgaacattcaaacaatcagaaagattaaatctggttttagcaagtatttgttgaacaattcgtttaataaattcagtcttggatataatgtgatctcaggttcaattcatcctacaaagttcactaatgcagacggtgagcctgtgaatgaggtattatcaagtgatcttggcatattgaatgacaacacaaaaccacccttggattcttatctttttgaggaagtcttttatgactcagagcttgaacggctcaacataacagatggagagatccagtctgtagctgtttttacaaagataccgaagaactccattaagatcccggtggcaggtggatacacgtactcccctgactttgcatatattgtcaaaacaataaaaggtgattatttaaactttattatcgaaacaaaaaatgttgatggaaaggatagcttaagacttgaagaagaacgtaagataaaacatgcgcaagcattatttagtcaaataagtaaatctgttaaagtcgagttcagaacacaattttctacagacagaatagctgaaatgattaaacaagttggatgataatatgttgtaaatggaaaagggtcttacggcccttttgttttcctttaaagggaactttccattagatagaatacatatccccacacttggggtaaatcaatcagctcattgggctgttaactacttctcatgtatggggcaatcagaccataatcataactaccgaccaagaataaattcaaacttccacaataaaatgtggagggtaaaataagttcctgacgccttgtctcttttatatcctatgtgatatttctgtaaatcaggaaaaagtatttaataacttttgttattacggtgaattaccaattaacttgtaccgccacaaaaaaatcaatccttattcgtttttacgagtatattattcctgtcttcctaccatattctcatgaaattttttcctctcagttataactttactttatcttcagcactaagattcaaagattgtaatactgatctttcccagcaataatggacacgtggctaagtgtgtaaactctcagtcagaagtaactcacatgacatagtatcaaccagataggtgtattacctcaccccctaaaaaactctttccgatgccactctacaataccctcaaaagggtaatttttacgcacctgtggcaacgcaataatttttccgtcaaaatcccagaatgacctctcaatgatctctccgccgtttaccgcatccgataccagtacccgcagattttcatccaggccaatcgttcctttatcaaaggctttatgatgtatcgcgcaaagcgccagaccattgggaatttcacaagggccatcacgctgtttccattttatatgtgtcgcttccagtgagacggtggagttgtcgtgacgaatattaaagctacatattgcgcactggtagttataagcgcgtaatacatgtttgcgaaataatgggtcacgctgcttacggatttgctggagagcaaaaaaagctcgtcagcgatttactggaagccattgatatcctggcagtgaaataattgcgatcatgctcgcaaattttctgctgttcaagcctgcaagcgaagatatattaccttgatctcatatgtttttttacttcctgtgtgccctaattgccatgcgatgttgcaccgacgcaaaccaccgtttacgctggaggagttaaaagcgctgatggatgcgaataaatcaaattaatgaacgctcacctttcgcgccaaaactgcaaaattgcttctacaaacctgtcagaaataatccctcgacgggctgccgcgctgaaatgactgcttcgcagtgccgtcgtccagttctccggtgaccggtacgctgaaccgtaatatcccgtgcttaaatcgtccgggtcttcattcggcgcgttcgtcagtcctctttcaccttgttgctggaagtcgacgaaaataatattggctaaaacattattttgataattgccataaatagcttcatacgcatgagggaaattttctttccagtaccaggtggtatcgccgcaaaaccacggcgcgtcagtaattttattaagctgagaatggtattgttttagatccctacgaaaggcgtcaaccatatgattaaagtgttgagggtgtgacgcgtagtcactggtcattaagtcaaattcgccttgcatccagcatacgccgaggaatttgttctgcggattttttgccagtgcggctcgcgttctgctgactaaatcctggtatagcggagtatccgatccccaacgacaagcatcatggctggctccgtgcggttctgaatatgtcccttcgctgcccgcggtaaaagctgatccgccacggcaacacggaacgatgagaacccctgcattatcaggaataaagggcagtaatttccgtgctatatgcagtgcctggccaacggtgccgtactgtgtttgatgattcgttgccagaggatggtgataaccctgcatatcctgaacatcgtgtgggcagtgagtcagtggaataatgtcgttaaagtgacatgacgggcctccgggatgtgtatgcgcaaatctcgctaattgtttaattctgggatgaggcgcatcttccttgtccggtaatggtagtccttcgccatacgccatggcattagactgaccagcaacggtaagaacatagtaataatcgggcgatattattgcgttcatataattttcgcgtaatacaaatgacaaattgatagcagggcccctttaccggggccctgaagcgttagttttgtactgtgactttattatccttcacagagatcaaaactgaatcagtcaccgctttgccgcctgcagtttcaccgccaataattaataaactattattccagggcaatgatactccgtaggcccgaccttgcgataattcgcccgatttatcccatttcccgttatgccaaagatgaatatcagcgctatatgattttttcaggccttcatgcgcatagttcttaccgttctggtaattttctcgtgaacctttgaatccggcccctccggcaaatataagtgagtcattgctcatgcctgcaaaaccgccagcgacgccatctggtgatgcgacgggagcaagcttattccattttaaattattaccggtgaaatcaagttcaaatacggcatccgttcgcaatcctggtttggcttcgccattaataagccaggttttatcacctttattcacaaccgccgcaccagccgttccgtaccagggagattcgccagcgtaactccattgctgtgtagagggatcaaaagacaacagaaacttattgaagaaataatcttctgcttttttgtcaaaatagtaggcgttgattttatctatagcggttgaatcttttccagcttcgttgagatcttcaaaatagccattgaagatattctggttaacaccgccagtaacataagccttgccgttgtgtacaaaagtcacatggcctgccatgcccatcggcgcgtgcgacatcaatttaacccagctattggttttggggttgtatttgtgtacgtcattaaatacctgagtcaagccctcgctgtttttgccaatgccgccaaacacatacagattgccatcaataaatgcagaggttgcttgatctctcggtccgccagggaatgcagctaacgctgtccatcttttatctttggcctgtgtatccagcttgtaccatgccgtacctgcgctacctaaaccaatgtagacagtgtcgttatcaattactccggtaccacttttaaatggcacaggagtttccggtaatacagacgcgtttgcggcaaatgaagccattaggatagcaagcgccgttattgttttattcattgtgactgtctcctgtctactacagtttaaatgacacaccaatgcgataactgttttccgataaattatctctgccgttgtaaacaccctgacggtcaaggtagtcatattctatgtatggcgtaatatcgggcgtcatatggtattgtagaacaaatgcattttccgtcgcccatttcttatggtttgcatagcgataatcgttctgtttgctgtatagcgtcgtttgccatgcgaaggtgaaatcactattaatatggtaagtgacatatccatcccaacgatgaacgttatcacgagacatatcaccggataagtcttgttgtcggtaagctttccagtcgtaacgatagcgaatgccaaaattaagatcttttgtcgcgtcccaggacagttttacgtagggtccgtagcgtgtgccgttgctgctaaaatgcgttaacattcccgggcgcaccgtccattgatcatcaagtttaatcgcgtaattaacttcaacctgaacatcattgagtgcggcattttcctttttattatcatgaatggtattccaggtattactttccatacttgcccaccatccattttgccatccctcactgactttgagtcgagtctcataggcgtggcttccactacgatatccaccacgtacgtccagtgtcgcagcctgggaaatcagtggtgacgaaaagcacagtaataatacgccagaaagtattttagcctttttcatatatttcactcatttgtaggatacagaaagcaatacaaagcccgcataaacaattagcatttatgttgtgtaatattttttgccaggcttatagtgtctttggcaacgagtagctgtattttatattttttgtataaggtctcctgtgaaaattctctttccacattatttaaataaacagagaaccagattaaatacctgagtataaaatctcttctgatgtttaattgatttgaatgttcgtaagctatatcacttactcaatccattttacccagagtcataaaatagagtgtctgttgatctcattttcatattcctttcagactgaagtgcgttttcatcacccgatgagaaagaactgaagtgatgtttgccatagattgcgagatgccctgtctcattgactatcgcgacgcacctttatacctgttataccagatcaaaaatcacgcaatccatacaacaaaacgagatttgcaattcgtgtcacaaaatatgtcgatctttttttaagaggaagatgccatgtgaagccagacgaacacttgaggtggtcttcaaaaactaaaggctttcttttaaccatttgttttataaaaaatttatttatggtctaaacaagggaagctttgcaagctaactcagtgagtgtggtgaaaacaagtgtttacccgccatcaggatgatcataattctcatcatgaaatatgtttcctggtttttggcttgtaagtggtcacccctgaagtcgatctggaaaggcttgtagatgttggtgttttcaggatgatgtttcagatagtttgtttgccgtatcgcccggcgaatagctgtgattgaggaagatttaagtcgcagtgaccaaagccatatttaccaacgaatgtagatgaaaaggcgtctcctgcgttcccccatatctccaggaaatacacagtctgaaaaaggaatgtaacaatctcatggcgtaagctgacgaaccaggcaggaataatcgctagggacctaagcattagcatgataatagccactaagaaattactgtgttccatgaaatagccattttgtggcaaatgcagttgactaataatgtcatatgtgagacggctagttgaacaaatattaaattttgctgaattttttatgttgattttacttgttacagaacatatcacatgatatatagataagattagttgcattaatgatgagggttattattcgattcgtatcagattgataaatatataaaggtacatagcatgcaagagcatggcgtttgtatggcaaagttattataagtaactatcgctactctatttaagttcactcagaagaactggtccacttacgttagttattaagcaaacgttcgcttttataaacataatcaggattaaaatgttggattattgctaacccagcacagctagtgcgcgtctgtaattataagggaaaacgatgaagaataaggctgataacaaaaaaaggaacttcctgacccatagtgaaatcgaatcactccttaaagcagcaaataccgggcctcatgctgcacgtaattattgtctgacattactttgttttattcatggtttccgggcgagtgaaatttgccgattgaggatttcggatattgatcttaaggcaaagtgtatatatatccatcgattaaaaaaaggcttttcaacaacgcacccgctattgaacaaagaaattcaggctttaaaaaactggttgagtatccgtacttcttatccgcatgctgagagcgagtgggtatttttatcacgtaaggggaatccactttctcggcaacagttttaccatattatctcgacttccggtggtaatgccgggttgtcactggagattcatccgcacatgttacgccattcgtgtggttttgctttggcgaatatgggaatagatacgcgacttatccaggattatcttggacatcgcaatattcgtcatactgtctggtataccgccagcaatgcagggcgtttttacggcatctgggatagagccagaggacgacagcgtcacgctgttttatagagatagttgagataccagggatggtgttaaaaactacattattcttacgatatatcaaaaatgattaaccatttattaattgatgttattgtaagtatgattcttaattatcataacaaacattaagttaaccatatccatacaaaatacaatggtttatgttcttcaaaataaataaacaaaatcattcataaatttacacatcacttaaattcgcctgttttcatacttttttctttattttttaagcaactggaagttaatccactgcaatctattgttatattgaatcaaatcaatgaaaatagatgttgtcacatcagtgatattttatttttgtatgatatttaatgtaattgactgatagccacatcacttcgggtgtggttatctttttatctattgggctaattttgaccgattgaggtttcctataggtattcattcaaatatatctcagtcaggagtactactattgtgagtaaacgtcgttatcttaccggtaaagaagttcaggccatgatgcaggcggtgtgttacggggcaacgggagccagagattattgtcttattctgttggcatatcggcatgggatgcgtattagtgaactgcttgatctgcattatcaggatcttgaccttaatgaaggtcgaataaatattcgccgactgaagaacggattttctaccgttcacccgttacgttttgatgagcgtgaagccgtggaacgctggacccaggaacgtgctaactggaaaggcgctgaccggaccgacgctatatttatttctcgccgtgggagtcggctttctcgccagcaggcctatcgcattattcgcgatgccggtattgaagctggaaccgtaacgcagactcatcctcatatgttaaggcatgcttgtggttatgaactggcggagcgtggtgcagatacccgtttaattcaggattatctcgggcatcgaaatattcgccatactgtgcgttataccgccagtaatgctgctcgttttgccggattatgggaaagaaataatctcataaacgaaaaattaaaaagagaagaagcttgatttaacttattgataataaagttaaaaaacaaataaatacaagacaattggggccaaactgtctatatcataaataagttacgtattttttctcaagcataaaaatattaaaaaacgacaaaaagcatctaactgtttgatatgtaaattatttctcttgtaaattaatttcacatcacctccgctatatgtaaagctaacgtttctgtagctcgacgcaacttcctcattcttctctccaaaaaccacctcatgcaatataaaaaactgcaaataaagataactatagagcattaagccaacaaataaactgaaaaagtttgtgcgcgatgctttcctctatgagtcaaaatggccccaaatgtttcatcttttgggggaaaactgtgcagtgttggcagtcaaactcgttgacaaaacaaagtgtacagaacgactgcccatgtcgatttagaaatagtttttttaaaggaaagcagcatgaaaattaaaactctggcaatcgttgttctgtcggctctgtccctcagttccacagcggctctggccgctgccacgacggttaatggtgggaccgttcactttaaaggggaagttgttaacgccgcttgcgcagttgatgcaggctctgttgatcaaaccgttcagttagggcaggttcgtaccgcatcgctggcacaagaaggagcaaccagttctgctgtcggttttaacattcaactgaacgattgtgacactactgttgcagacaaagcagctattgccttccttggtaccgcaattgatggaaatcatcctaacgtattggctctgcagagttctgctgcaggtagcgcaacaagcgttggtgtgcaaattctggacagaacaggcaatgctctgacgctggacggtgcgacatttagtgcacaaacaaccctgaataacggtaccaacaccattccgttccaggcgcgttattatgcaatcggcgaggcaaccccgggtgcagctaatgcggatgcgaccttcaaggttcagtatcaataacctacccaggttcagggacgtcattacgggcagggatgcccacccttgtgcgataaaaataacgatgaaaaggaagagattatttctgttagcgtcgttgctgccaatgtttgctctggccggaaataaatggaataccacgctgcccggcggaaatatgcaatttcagggcgtcattattgcggaagcttgccggattgaagccggtgataaacaaatgacggtcaatatggggcaaatcagcagtaaccggtttcatgcggtaggggaagatagcgcaccggtgccttttgttattcatttacgggaatgtagcacggtggtgagtgaacgtgtgggtgtggcgtttcacggtgtcgcggatggtaaaaatccggatgtgctttccgtgggagaggggccagggatagccaccaatattggtgtagcgttgtttgatgatgaaggaaacctcgtaccgattaaccgtcctccagcaaactggaaacggctttactcaggctctacgtcgctacatttcatcgccaaatatcgtgctaccgggcgtcgggttactggcggtatcgccaatgcccaggcctggttctctttaacctatcagtaattgttcagcagataatgtgataacaggaacaggacagtgagtaataaaaacgtcaatgtaaggaaatcgcaggaaataacattctgcttgctggcaggtatcctgatgttcatggcaatgatggttgccggacgcgctgaagcgggagtggccttaggtgcgactcgcgtaatttatccggcagggcaaaaacaagtgcaacttgccgtgacaaataatgatgaaaatagcacctatttaattcaatcatgggtagaaaatgccgatggtgtaaaggatggccgttttatcgtgacgccacctctgtttgcgatgaagggaaaaaaagagaataccttgcgtattcttgatgcaacaaataaccaattgccacaggatcgggaaattttattctggatgaatgttaaagcgattccgtcaatggataaatcaaaattgactgagaatacgctacagctcgcaattatcagccgcattaaactgtactatcgtccggctaaattagcgttgccacccgatcaggccgcagaaaaattaagatttcgtcgtagcgcgaattctctgacgctgatcaacccgacaccctattacctgacggtaacagagttgaatgccggaactcgggttcttgaaaatgcattggtgcctccaatgggcgaaagcgcggttaaattgccttctgatgcaggaagcaatattacttaccgaacaataaatgattatggcgcacttacccccaaaatgacgggcgtaatggaataacgcagggggatttgcctgaataaaaagaattgactgccgggtgatttaaaccggaggaataatgtcatatctgaatttaagactttaccagcgaaacacacaatgcttgcatattcgtaagcatagtttggctggtttttttgtccgactctttgttgcctgtgcttttgccgtacaggcacctttgtcatctgccgaactctattttaacccgcgttttttagcggatgatccccaggctgtggctgatttatcgcgttttgaaaatgggcaagaattaccgccagggacgtatcgtgttgatatctatttgaataatggttatatggcaacgcgtgatgtcacatttaatacgggcgacagcgaacaagggattgttccctgcctgacacgcgcgcaacttgccagtatggggctgaatacggcttctgtctccggtatgaatctgctggcggatgatgcctgcgtgccattaacctcaatgatccatgacgctactgcgcatttagatgttggtcagcagcgactcaacctgacgatccctcaggcatttatgagtaatcgcgcgcgtggttatattcctcctgagttatgggatcccggtattaatgccggattgctcaattataatttcagcggaaatagtgtacagaatcgaattgggggtaacagccattatgcatatttaaacctacagagtgggttaaatattggtgcgtggcgtttacgcgacaataccacctggagttataacagtagcgacagttcatcaggtagcaaaaataaatggcagcatatcaatacctggcttgagcgagacataattccgttacgttcccggctgacgttgggtgatggttatactcagggcgatattttcgatggtattaactttcgcggcgcacaattggcctcagatgacaatatgttacccgatagccaaagaggatttgccccggtgatccacggtattgctcgtggtaccgcaatccctattggcggtggcagcgccaatgtttatgtaaaccttgcgcctgccgtgaatgtggggcaaaacctggtcgtggatctttcgacgcaaatcttttgccataacgattacccggaaaccattacagactatgtcacactgcaacgaggttcggcttatggcggcgtgttatctagtttttccgggaccgtaaaatataatggcagtagctatcctttccctactaccagcgaaacgccgcgggttgtttataattcgagaacggataagccgtggccggtggcgctttatttgacgcctgtgagcagtgcggggggagtggcgattaaagcaggctcattaattgccgtgcttattttgcgacagaccaacaactataacagcgatgatttccagtttgtgtggaatatttacgccaataatgatgtggtggtgcccactggcggctgcgatgtttctgctcgtgatgtcaccgttactctgccggactacccgggttcagtgccgattcctcttaccgtttattgtgcgaaaagccaaaacctggggtattacctatccggcacaaccgcagatgcgggcaactcgattttcaccaatatcgcgtcgttttcacccgcgcagggcgtcggcgtacagttgacgcgcaacggtacgattattccagcgaataacacggtatcgttaggagcagtagggacttcggcggtaagtctgggattaacggcaaattacgcacgtaccggagggcaggtgactgcagggaatgtgcaatcgattattggcgtgacttttgtttatcaataaagaaatcacagggcattgctaatgcaggtacgcaatattacctgaagctaaaacctgcacgttagccctttgtaggccagataagacgcgtcagcgtcgcatctggcataaacaaagcgcactttaccgacaatccgaacagagcctgccaatggcaggctcaggtgctcttttacgctaccatgctaataatcagcacaataatcagcccaaccacggagttgaccagctccagcagaccccaggttttcaacgtgtcttttactgacaggtcaaagtaatctaagaggcattgctaatgtagggaatgtgtctgaacctgcggtcattgtcagtaccagcatcaggccaatgccgaataccacccagagaatgttaagcacatgcataacgttttaccttacctggttgaaccgttgttattttgggcgacatgttatgtaaattggtcaaccattgttgcgatgaatgtcacatcctctgatcaataaccatcgattaccctttgctgcaatttgcagcaacaaccaggagagtgaaattcttgtgatgtggttaaccaattttagaattcgggttgacatgtcttaccaaaaggtggaacttatacgccatctcatccgatgcgacgctacggctgtggccgggttgttcatccggatacctaaacaactccggggttccgcgtctcttcgctgttgaacccactatgtgaaagaggaaaaatcatggaacagacctggcgctggtacggcccaaacgatccggtttctttagctgatgtccgtcaggcgggcgcaactggcgtggttaccgcgctgcaccatatcccgaacggcgaagtatggtccgttgaagagatcctcaaacgcaaggcgatcgttgaagacgcaggcctggtatggtctgtcgtagaaagcgtgccaattcacgaagatatcaaaacccacaccggcaactatgagcagtggatcgctaactatcagcagactctgcgcaacctggcgcagtgcggcattcgcaccgtgtgctacaacttcatgccggtgctcgactggactcgtacagacctcgaatacgtgctgccagacggctccaaagcgctgcgtttcgaccagatcgaatttgcagcatttgaactgcacatcctgaagcgtccaggcgcagaagcggattacaccgaagaagaaattgctcaggcagcagttcgcttcgctaccatgagcgacgaagacaaagcgcgtctgacccgtaacatcatcgccggtctgccgggcgcggaagaaggttataccctcgaccagttccgtaagcacctggagctgtacaaagatatcgacaaagccaaactgcgcgaaaactttgctgtcttcctgaaagccattattccggttgccgaagaagttggcgtccgtatggcggttcacccggacgatccgccgcgtccgatcctcggcctgccgcgcattgtttccaccattgaagatatgcagtggatggttgataccgtaaacagcatggcgaacggtttcaccatgtgcaccggttcctacggcgtgcgtgctgacaacgatctggttgatatgatcaagcagttcggtccgcgtatttacttcacccatctgcgctccaccatgcgtgaagataacccgaaaaccttccacgaagcggcgcacctgaacggtgacgttgatatgtacgaagtggtgaaagcgattgttgaagaagaacaccgtcgtaaagcggaaggcaaagaagacctgatcccgatgcgtccggaccacggtcatcagatgctggacgacctgaagaagaaaaccaacccaggttactccgcaattggtcgtctgaaaggcctggccgaagttcgcggtgtcgaactggcgatccagcgcgctttctttagccgttaatatccaccggcatggctgcgcgccgtgccggttccttcttccttgccgtcactctctgaagacggattctggagtttacgatgactactattgttgacagcaatctgccggttgcccgcccgtcatgggatcattctcgtctggaatcacgcattgtgcatctcggttgcggagcgtttcaccgcgcgcaccaggcgctgtatacccatcatctgctggaaagtaccgacagcgactggggtatctgcgaagttaacctgatgccaggcaacgaccgcgtgctgatcgaaaacctgaaaaaacagcaactgctgtacaccgtggcggaaaaaggcgcggaaagcaccgagctgaaaattatcggttcgatgaaagaagcgctgcatccggaaatcgacggttgcgaaggtattctcaacgcgatggcgcgtccgcagacggcgattgtctctctgacggtcacggaaaaaggctactgcgctgatgcggcgagcggtcagttggatctcaataacccgctgatcaagcacgatctcgaaaacccgactgcgccgaagtctgcgattggttacatcgtagaagccctgcgtctgcgtcgtgaaaaagggctgaaagcgtttacggtgatgtcctgcgataacgtgcgtgaaaacggtcatgtggcgaaggttgccgttcttgggctggctcaggcgcgtgacccgcaactggcggcatggattgaagaaaacgtcaccttcccgtgcaccatggttgaccgcatcgttccggcggcgacgccagaaaccttacaggaaattgctgaccagctgggtgtttacgacccgtgcgccattgcctgcgaaccgttccgtcagtgggtaattgaagataacttcgttaatggtcgtccggactgggataaagtcggcgcgcagtttgttgcggatgttgtaccgttcgaaatgatgaagctgcgtatgctgaacggcagccactctttcctggcgtacctcggttacctcggcggctatgaaactattgccgacaccatgactaacccggcttatcgcaaagcggcctttgccctgatgatgcaggaacaagcgccaacgctgtcgatgccggaaggtacggacctgaacgcctatgcgacgctgctgatcgagcgtttcagcaacccgtctctgcgtcaccgtacctggcagattgcaatggacggcagccagaagttaccgcagcgtctgctggacccggtgcgtctgcacctgcaaaacggcggtagctggcgtcacctggcgctgggcgtggctggctggatgcgctacacccagggcgtggatgagcagggtaatgctattgacgtggttgacccgatgctggcggagttccagaagatcaacgcgcagtatcagggtgcagaccgcgtgaaagcactgctgggcctgagcggtatctttgccgatgatctgccgcagaacgccgactttgtcggcgcggtgacggcggcatatcagcagctgtgtgagcgcggtgcgcgcgagtgtgtggctgcgctgtaactaactgattaccctacagacttactggtcaatcaaactaatatttggttgaccagttttcgtttttttgcccacctgtacgtgccaacatccagtgctaatggtatagtttgagcttaacgggtgccgtaaaattgcccgttgtaggtcggataaggcgttcacgccgcatccggaaaaaatttgattaaccgcacctaacggacacaacaccatgaaatctgccacctctgcgcaaagaccttaccaggaagtcggggcgatgatccgcgatctgatcataaagacgccgtacaatcctggcgaacggctgccaccggagcgtgaaattgcagaaatgcttgatgtcacgcggacggtggtacgtgaagcgctgatcatgctggagatcaaagggctggtggaagtgcgccggggtgccggtatttatgttcttgatagctcaggcagccacaacacagacagtccggatgccaacgtctgcaacgatgccggtccttttgagctgttacaggcgcggcagttactggaaagtaacatcgccgagtttgccgccctgcaggctacccgcgaagatatcgtcaaaatgcgccaggcattgcaactggaagagcgtgaactggcttccagcgcgccgggcagcagcgaaagcggtgacatgcagttccatctcgctattgccgaagcaacgcataacagcatgctggtggagttattccgtcagtcctggcagtggcgggaaaacaatccaatgtggatccagttgcacagccatctggatgacagcctgtatcgcaaagagtggttgggcgatcacaaacagatcctcgctgcgttaatcaaaaaagatgcccgagcggcgaagctggcaatgtggcagcatctggagaatgtgaagcagcgcttgctggagttctctaatgttgatgacatctatttcgatggttatctgtttgattcatggccgctggataaagtcgacgcctgatccctcatttctggtgcaaagtttaaccgctttgcactatgtattgttccctgagtagttaatgatgttctgcagaatatattatgcgtaatttaatcgcggttagccacttagtttttcatggatttctataaattgccgagggggaacaaggccgggagctgcgacagcaaatacaaaataagtccaatacaaccgccaaccagcgtaccgttgacacggataaactggagatctttgccgatatttaactcgatttgccgcgacatatcccgtgcgtcccagctttttaccgtgtcgctgatatggcgagtcaggaatgcggaaaactcaggcgcaatgcggtgtgcggcttgttccagatgaccatttaacgacgcccgcaaggcatcatcggcaattaacgtttcgccaaaccattgacccgcccgcgcgatacgttctttcacacgagaatcttcactgttgatatccgctttcagccattcccgtaaatccccccacaattcactgagatagcggttaaaagcttcatcttctttcagatagctttttacggcatcggctcgcgctgccatttccggatcgtttttcagcttgtcgatcagggcaaaagtggcgcgatcaaacgcatggcggatctgatgcgcacgatcgcggctgatatcatcaagcaaagaattcaccgcgtcagaaaccaactccgcgctatgttcgcccagccattcagtgggcaaaattttggctttcagtggatgttcgctctccagccagcgaacaatttgctgggcaataaacttgcgtgatttatcgcgctggagaagggcgatcaactgtgcgatcagcgtatccagcagcacctgatgacgatcgtttttggtcatactctccagcatcaacgcactggtgccagaaagatcgactttatcaatcgcccggtggaccgcgcgcttaagcaggcgctgaatacgcgcatcatcggtcagttcgagaaaaccgctcatgatctgtaacagatgctgaccaacgcggcgggcgttctccggctgactaaaccagttgccaatcaacaacgccggttcgtgacgtcgaatcaatgccaccagcgattgggtatcgagaaatttttcctgcacgaactggccgagattttcgccaatccggtctttattacgcgggataatcgccgtatgacgagaaatgatcggaatcggcacgcggcgaaacagcgccaccaccgcaaaccagtccgccagcgcgccgaccatcgccgcttcagcaatcgccttcacgccgctcacccaaaaattgggcggcaaaaacagcgtaacgacaaaggtagcagcggcgataagcagtaaagagagcgccaacattttggcgcgtctgagttcaatgagtttattcatatcgtaagaatagagcctgacggtaagaaaacgcaaaaagcgagatatcttccataaaaatgtatcgtttgcagaagaataaaaatagcctggaaaccgcctcggggaataggaaatagccaggtgtgaatggctttgttagtcgctaaagttgggccatcttatctacaggtgacggatcgccatgacaaacttcacgaccagcacgccgcatgacgcattatttaaatcctttctcacacactctgacaccgcgcgggattttatggagatccacttacccaaagatttacgtgaactgtgcgatctcgatagcttaaaactggaatccgccagctttgtcgatgaaaaattgcgggcgctacattccgatattctgtggtcggtaaagacccgtgaaggcgatggctatatttatgtagtgattgaacatcagagccgtgaggatattcatatggcctttcgtctgatgcgatattccatggcggtgatgcagcgccatatcgaacatgataaacgccggcagctaccgctggtcatcccgatgctgttttatcacggtagccgtagtccttatccctggtctttgtgctggctggacgaatttgccgacccgactaccgcacggaagctttataccgccgcgttcccgctggtggatatcactgtcgtgccagacgacgagattgtgcagcatcgcagagtcgccctgttggagttgatccaaaagcatattcgccagcgcgatctgatggggcttattgaccaactggtagtattactggttacagagtgtgctaatgacagccagataactgcgctgttaaattacattttactgactggtgatgaagcgcgttttaatgagtttatcagtgaaattacccgtcgactgccacaacaaagggagcgaataatgacgattgcagagcgaattcataatgatggatatataaaaggggaacagcgcattcttcgattgtttttgcagaatggggtagatcctgaatggatacaaaagattaccggactttcggcagagcaaatacaggcattagagcagcccttgcctgagcgtgagccttattcatggctcaagagctaatcagagacggatgacaaacgcaaagctgcctgatgcgctacgcttatcagacctacattatctctgcaatctattgaatttgcgcggtttgtaggccggataaggcgttcacgccgcatccggcatgaacgaagcacactttacgtggcgatgatagtgaccttcctgcaccaacgttgccgccgccatttatgtgaacggtacattaacgctgctggtggcagcaaatgcagacccggtgcgtgttacagcaggtgagagatgaacggttaaaggatattgggttatgcagggaggatgtggtgtaatggagagagtccttcacgaaacgatgggatttatatgtcacctcgtcagataagggaaatcatcgcttcacggaaagacgtcagaatgaaagctacagaagcccgcctactcgattttttaaaacgttcgcagcagttcgttattcccatttatcaacggacttattcatggacagaacaacaatgtcggcaactttgggacgacatcattcgtgccggaaagcgtgacgatatatcagcgcattttatcggttcggttgtttatattgagcaggggttgtatcaggtttctggtatttctccgttactggtcattgatggtcaacaaaggctgacgaccgcaatgttgctgattgaggctttatcgcgtcatcttggcgaagacgaagtttttgatggcttttcagcaatgaaattgcgtaattattatttactcaatccttatgagtccggcgagaaaggatttaaattactgctgaccgagactgataaagacagtttactggcgttaataaaacaaagaccaatgccagaaaactattcccatcgaataatggaaaactttactttctttgatgagcaaattaccaaactcggtgatgacttgatccccttatgtcgtgggttagcaaagttattaattgtcgatgtggcgcttaatcgtggtcaggataatccgcaactgatttttgaaagtatgaactctaccggtaaggcgttaagccaggccgatctggtgcgcaattttattctgatgggtctcgaaccagagcatcaaacccggttgtatgaagatcactggcgtccaatggaagtcgcttttggtcagcaaggttacagcgaatattttgacagttttatgcgtcattatctgacggtaaaaacgggggagatccctcggacagatgaagtctatgaggcatttaaactccatgcccgcagccagagtgttgctgaaaaaggcgtagatcggctggttgaagatattcacatctacgcggagtattactgtgcaatggcattgggaaaagaaattgacaaatcgcttgctacggcttttcaggatttgcgcgagttaaaggtcgatgtggcgtatcctttcttactggcgctttatcatgactataaaaatagcgatttgtctcacgaagatttcctgagcataattcgtttaattgaatcttatgttttccgccgtgcagtgtgtgcaattccgacaaattccttgaacaagacgtttgccactttttataaagtcattaataaagaaaaatatctggaaagtattcaggtacattttctgaatctgccttcatatcgtcgtttccccaacgatgatgaatttaaacgggaattaaaagttcgcgatctctataacttccgtagtcgcagctactggttacgacgactggaaaacgataaacgcagagagcgcgtggaagagtttacgattgagcatattatgccgcagaacgaaaatttgtcggctaaatggcgtgaagagttgggaagtgactggcaacgcattcataaagaactgttacatacgttggggaatctcactttaacgcgctataactcccgttacagtgacagacctttcgcggaaaaacgcgatattgaagacggctttaagcatagcccgctttatttgaatatcggtcttggacagtgcgaaaaatgggatgaagccgccattcgcgcccgtgccgatcgtctggccgatctcgcggttcaggtctggcaagcgcctgctcttcctgaagaggttttagctgtttatcgggaacagccagaaaacaaaaccagttacagcttgagtgattatccttttcttgctgatggttcgcatagccggatgttattcgatcatcttcgcgatgaagttatgcgcctggacgcagggatcacgcaggaagttttaaagctctatattgcgtttaaagctgaaacgaattttgttgatgttgtaccgcaaaaaagccgactgcggttgtcgcttaatatgcagtttcatgaactggtcgatccgaaaggtattgccaaagatgtgacaaatgttgggcgatggggcaatggtgatgtggaaattggtttcagtgacctcgcacaacttccttacgttatgggattaattcgtcaggcatttgaaaaacagatggagagcgcgttggtctaacacggcgaataatacccggtagcactggcgctaccgggtcaatgtatcaggcgactttctttttacctgtaatcaccccaataaattcctgcacctgcttttgtttacgcgccgacagtttgcacacctggcgtagtgactgcatcagctcgctctcttcggcggcggtgggttgggcggtgaggacaatacagccttccattactttgacatctatcgccgtgccggtggcaaaaccggcggctgccagccactgacctttcagggtgatggcgggaatacggctgtaatccgggtagcggctcgcataaccgacggtgacatgacggttatttgccggggagacttctgcttcgaacggttgtgcaatagaatgcgtgtcagtcataactgctattctcctggaatagtgattgtgatgagcggtgcgggtgtgttggcgcacatccgcaccgcgctaaatacctggatatatcatcagtaaatacagggaaagtccagctaaaaattaatgaaaataagatgaaaattagcgtaaaatataatttttggtgatgtgaataaagcggctattgagccgctttattggttttttgagggcgagaaaattagtttatcgccgcgtcagtgagtgcgtctgcaacgtgtagttgggtttgctgggcggattgaagtcctaaaaataaaaatctacatttttccataaggatactaactttattaactatattcctttgttccgccaatgggggggtagggaatagaaatttactaatttctccaagatataggcatggttgagctccgcctcgtttatgagagtgaatcattgactgtaataacttcgagtccattgcaagttttaaatactcaggttcgattaataatggttttataatcgctacgctccttacgagtgcgaaatcagaacagtccttaattaaagaagatctaccaattgttccaccaaccgaaacaattaataagtcacctttttcaggtaagcatcgctcacgggatttttcgtagtcaatcgctgagatataatcacagttattgtagtctaaataaccgtcacggatattttttgctgaaagtaatttatacccttcggcaatacgaggtggtgttttatgatctccatcagtaattttagatgaaatatcatttaaacgacaccactcccacccttccggaagttcaaacggtttttcctcatcgctaatcgggggcaacggtttttgtttttttattttcccttctttcaccagttgagctttttcctgcgcaattcgtttgagcagttcagaggctggttcgtcattcggatcctgcggcacaagtttacccattacggccagttgcagaatggtctgttttaacgcatccacgctggcttcagtggtaaatagtgtgtcgaaatgttcgctaatacgcgcccagttttcagccagttcctcggcgttttgactgtctgtaagcgttcccaacagggtttcaaccagttgctgatgtgcgtccagagtggtcagggattgctgttccagttggtcgcaaagagacatgagttttttgacagtacttaagatcctattctgctctgcgaatggtggaatcatgaatgggtgtgatataaaatcttcaaacaacaggctttcaacagtagttcctgtttttgttaaattctcaattatatatctttcgaaaccattcatcatcaatagtatatagtatgaaatatcactaaaaaatggtgataatacttttatatcttgattaactgtacattcaatagatgttatagcaactgggaaaattcttcttagaattccacttcttgcgacaaatagtatactgcctggagatactttggttaaaccatcttcaagggctaaaggagtcaccttatcttcagaatcgactattagattcgttttcatatcttttggggttacccatggaatagttcctccccaatattcatctttcattttacttggagttttaccaccaaaaaaatagcctaaatgtgaaaaagttacccactcccatccctccggcaattcaaacggcttctcttcctcgctaatttccggcaggggtttttgctttttaattttaccttgcttcaccagctctgctttttccgccgcaatacgcttcagcagctccgacgccggttcatcattcggatcctgcggcaccagtttaccgcgcaccgccagttccagaatcagctcacgcaatttcttaatgccatacaaatcaattttaccggaactgccgcgcccggcggtggaacgggtttgcaacgccgaggtccaggtttccatatgatcaacgatcagcttttccacactcattagttaacctccttgccagacagcgcagcgccaagaatatcgcacagttgattacgcagcgtctggatctccgcctgctgttttgcatactgcgctaacagttcgtccggatcatggctaacggtttccgcctgatgtgggtttttaatatccagattgaagttacgcgcaatcacgtcatcaatgctgactttccatgcctgctcattctcgacgcggctggcaaaaccatcggcctcgttaccccaccagtcgatttccgcctgaaactcttcaaacttcatcggcttggttttactgtaatttttcacgcccgccggatacggatgctcatagaaccaaatctctttggttggctgacctttggtaaagaacaacaggttggttttaatgccggtataggggttaaacaccccattcggtaaacgcacgatggtatgcagattgcactcttcggtaagcagctttttgattttggttttaacgccttcgccaaatagcgtgccatccggcaataccaccgccgcacgaccgtttttcgccagtacttccacaatcagttgcaggaacagatccgccgtttcgcgggtttgcatctctgccggaaagttcttctcaataccgtcttcttccgtgccaccaaatggcgggttggtaacaatgacatccagttgctcatcccaggaggaaagcggcttgttcagggtgttgtcgtgacgaatttgtaccggtacttcaatgccgtgcagcagcatattggtggtcgccagcaggtgcggaagctgttttttctcaacaccgtggatctgttgttgcagcgtctgatgatcggcgacgctcttcacgtatttgttctttacatgatcgaacgcgcaggcaagaaaaccgcccgtaccgcaggccgggtccataatggattcgccgagtttcggatcaacgcgatccaccataaagcgagtgacggcgcgtggagtatagaattcgccagcattgcccgcagattgcagatctttaaggatctgttcgtaaatatcaccaaacagatggcgttcgctggcgctggtaaagtcaatttcgttcagcttgttgatcacctggcgcagtagcgtaccgtttttcatatagttataggcatcgctgaacgcctgcttcaccacgtagccgcgtgggtttttatcgataggcgcagtgaggtttttcaacgccgggaacagatcatcattaacgaattccagcagggaatcaccggtaatgccctgagcgtttgcggcccaactgcgccataaataacgctgtgggatcggatattgatagttatcctgctccagttccagcgcctcttcctgggcatcgaagattttcaaaaacagcagccaggagagctgaccgagacgctgcgcatcgccatccacaccggcatctttgcgcataatatcttgtaatgatttgattactgaactgatagacatgttgtattccatgaaaaacaaggccttctgcaacatgatggttgcagaaggcgcaaaagagagttgttaagcagagcggggcggtaattggtagatttcgttttccagctcgctgagcgcctgattatacccgttacggtcgccaaatccggttttaataatctccggtagggtgcccatgctgtcgaatggtttaagtttcagcacctgaatactttcgatctcctgtatgcccgcatcggcgtatttatccagcagattatcgagcacggcttgcgctgcttcagagtattttgtgaagtagttccgcttgcgcacgttctcggcgcgctctttgcgggttaacggcggctgaccatacactacgtggcaaagcatgtcgaacgggtcgagatctttaccgacttcttctgccagtacttcccagatgatcccctgttgttccagctcgtgaatgatcgcttctttgcgatcggcgtcttgccacttgcgggtaaagtcatccagcgaggcatattctttgagcagtgttttgcgggtgtaatctttaaaagattcggtaaccagtttaccgtcggcatcgtaatactgaacacgctgcgcaataacacccaccgccacgccattgacgtgaaacttgcggattttcttctcgtcttcttccggaagtgggccaacatcatcggtatcggtaacctggtatggtggcgcaggcggttcatcaacgcctgttacctgttcgtcgtcatgttcgctgatttcttcgagtttctcttcaaaatcagattctggatcggcgatatcctctggtgtggtatccatgactttttcgggaatgccatcgaaacgctcatcggcaaacagttcggtggcttttttaaagtcgaggatggtaaaccagagtttgccgtaacgttcgtcgatgcgtgtaccacgaccgataatttgcttgaatttggtcatcgactggatgttctggtccagtactaccagtttgcaggttttagcatccacaccagtggtcatcagttctgaagtggtcgcgataaccgggtatgcttttttcgggttgatgaagttatccaactgggctttgccaatttcatcatcgccggtgattttcatgacgtatttgtcgttctttttcacctgctccgggttgagattcaccagggcgcggcgcatacgttctgcatgatcgatgtcgttacagaagacgatggttttatccatcgggttggtgcgcttgaggtagtcggtaatggttctggcaaccagttctgtgcgttcgtcgattaccatcgtgcgatcgaaatctttctggttatagatacgatcgtcgatcacttcgccgtttaagtcagtttgccctttggttgggcgccagccttgcagatcaacatcaatatcaacacggacaactttataaggggcgaggaagccgtcttcgatcccttcttttagtgagtagacgtaaaccggatcgccgaagtaatccgtgctggagacttcatgcgtctcttttggcgtggcggttaagccaatttgggtggcggaactgaaataatcaaggatctctcgccaggcgctgtcttcggatgcgctgccgcgatggcattcgtcgatcacgatcagatcgaagaaatctggtgcgacttgtttaaacgctttttggtcttcctccgggccagttatagcctgatagagcgcgaggtgaatttcataagcgggatcaatggtgcgtccgctgactttggtcattgccgtaccaaatggctggaaatcattatttttggtttggtcgaccagaatgttgcgatcggcaaggaacaaaatgcgttttttattttttgatttccacaggcgccagatgatctggaatgcggtgtaggttttccctgttccggtcgccatgaccagcagaacgcggttttgcccgttggagacggcttcaatggttttgttgattgcctgaagctggtaataacgtggcgatttaccgctgccatcgtcgtaatagtcctgagtaatcaccggaagctgagcttgtgtgtatcctttccagaggcagaatttttgccagagttcagcgggggaggggaagtcatccagcgttatttgcttttcaaggcattcaccttcggctgcggtggcatcgcggaagataaagccatccccgttggtggcaaaaacaaaaggaacgtccagcaggcgcgcatattcaatgccctgttgcatccctttgccaatttcatgtttgttggcttttgcttcaatcacggctaagggaatgcctggtttgtgatacagcacgatgtcagcagattttactgttctgcgtgccgcaactttaccacgtacgatgactttaccgtcccggagtttgacctcctgtctgatttgcgttgtgttgtcccagcctgcattgagaatggctggcataacgcatttggtaatgatgtctgcttccgtcaggttacttaggttcagttccgccatggggtgttctcgcttttatcaggacgattctgattgtacataaaatcaatagcctggctatgacttagggcggtgtttcaacgtgaagtacgtagcagagatcacattgatatctctgttatatcttgcttgaattaatctgggcatatcagagacagataaacagaagttacaggaaccgtatcaactctaacaaaatatataaaaatcttatagttgcgtttctttcgagcaagaaagataatgttattgttgattgtttgattgggtatatgaaatggaagctaaagaatgtaaggtgcaggatatccttactgaaaacaaaaagtttattattccttcttatcagcgtccttacagttggacggtagataatgcagagcaactcattgatgacatttataaaagctctcaatcagaagagaatgaatattttattgggagtatgatttgtatcaataaagggcaaaatcagtatgaagttgtagatggacaacaacgtcttacaacgttaagcattattgtctccgagctaaaaaaatcatcccgattcaggggataaaagatgatttgcaaaaaagagttctgcctattgatgtttattctgatgaaacagatgaaccaaggctaattgttagaaaaaaaagagtatgatctttataaatattatatacttcaggattctaaagattataaacctgaaaaaccatcggatactgagttagtattcattagcaacgctgaaacaattagagattacttgttgcggttatctgttgatgagttgaagttgcttgctaaatatattttgcaaaatgtatatatcgtatttgtgcaaactgatgatttcgcatcatcatttagactctttaatgtattaaatagtcgaggtttacctttaagtaatgcagatcttttaaaaaatgcactgtttgaatcagcttctacgcataataaaaaatcagagcaaatagaatcagcatggtcgcaaattgaagatatggttggagtgagacggcttgataaatttcttactcttcataagctttccgagaaaaaagatcgtgacagggtgttacaaaaaggttttgaagcttttattgaaaatctccagcagcaatttgatggagatgctattgctatgtcactgatgttggttaattctgcaaaaaattatactaagattttagagaatgattttgaacactcttcaatacgacgaaaaatagcatcactaagtaatttaggggtagatgagtggattcctccggttatggcattcatgaatcgaatggctcgtacagaagattttaatttagatgatttttctcaatttattaccgcctttgagaaggtatatatgcatgggtggttaaaaaaacaaattaaaagccaaagagaaatggtttgttattcagctctggtagcaataaataatgatatgtcttttgattctgtgataaatcagataaaccaacatgcagataattcaggttttatagctgctctggatgaagatttatatgagcctcgtccgaatcaagtgaacttaataaaagcaattttgcttcgcttagatatggagcaacaagatgagagcgtgattaaaacctatacggggagaatcacaattgagcatattcttcctcaagcattagttaatgaatactggattaatagattccaacctcaagagcatgtctactggctgcataaaataggtaatttaacactcataagtggttccaaaaattctgaagcacaacactatgattttatcaaaaagaaatctatttatgagaaacttaatagtaaaagctcttttgatttaacaaaagatgtttgtaattcttcagaatggggattggctgaactgaaaatgagacatgaaaaaatgaaaacgcaattgaagaagctttggttggtctgacatatctaaagagttccactcgtaataatgttgcggtggaactctcaaaaagttgatctttcccgaacttacttcctcaacccagcaaacgccgcccgaatctcttcttccggcagctgaatcccgataaacaccatcgtactatgcggtttttcatcgccccacgggcggtcccagtcggcgctgtagaggcgttggacgccctggaacagcaggcgattaggttcgccgtcaatccatagcatccctttgtaacgcagcagtttatccgccgattccagcagcaggttttccatcacccgggaaacttcgctgatatctaccgggtaatccagttccaccacaatcgacgaaatatcgttttgtttgtccgcgataaagtgaaaacgtggcttggtgctgacgacgttttcttccagcataaaaccgttggtgttgaacagcaggcccaggtcgatgtcgccgtgggtgacggtgtagaccggtgcacgggcgttgatgcgcgccaggcgttcacgcagtttttctgcttcgcctgcgacgtcggttttagtcagcagaatacggtcggcgtagccaacctgtgactgggcgatggtgaactggttcatctgctcatcggcatgtaccgcatccaccagcgcaatcactccgtccagcaggtaacgctggcataaaacttcatgggagaaaaaggtctgaataatcgggccgggatcggccatgccggtgcattcaatgaccagacggtcgaactgaatatagcccttgtcgagattgtccagcaggtcgagtagcgcgtcctccagctcgttggagcgcgaacagcagatgcagccgttggtcagcgtttttatttgcgtggcgcgatcgccaatcagttgatcatcaacggagacttcgccgaattcgttttcaatcacggcaatcttgtagccgtgttgttcgttaagaatatggcgcagcagggtggtttttcctgcgcctaaaaaaccggtgagtagggtaactgcaatcgggttcatgctctctccattaacaacagcgcataccgcctttaccatcgccgccgtagcgcgcgttctggcgttcgcggaagaattcttcatagctcatgtacggcttgtcgggatggttggtcttcatatgctcgacgtagttgtcgtagtctggaatgccaatcaacatcttcgccgcctggccgagatatttttttgcctgtcctaagttaccaaacattttgccttccagatatgcgtaaagcccggaaggtccgggctggggatttgccggatgcggcgtaaacgccttatccggcctacgatagacattttgtaagccggataaggcaaccggttagtggtgcgaagagatcttcacgccgccttccgggattggaacgtacggtgtttctttgtcagtacgtttgtcgctgttacgcaccttcagccaggttttgaaaccgtagaagatgatgctgtacaccacaatcaggaacagaatactcaggcctgcgttggtgtagttgttcacaacgatgtggttcatgttggcaatctgctgcgccgtcaggtcagtaccgttagcaatcttctctttgtactggcttgccatgtagaagaagccttccatctgcgggttggtactgaacagtttcaggcccagcgcccaggtggtgcagataagcagccatacagccggaacaacagttacccagatgtattgggtgcgcttcatcttaatcagcacaacggtgcccagtaccagcgccacggctgccagcatctggttggagataccgaacagcggccacaggctcttaacgccgcccagcggatcgaccacgccctgatacagcaggtagccccacagacccacacagcccgcagtaccgatgataccggcaaccagggagtcggtttttttcaggaacgggatgaagttacccagcaggtcttgcagcataaagcggccagaacgggtacccgcatccagcgcggtcaggatgaacagggcttcgaacagaataccgaagtgataccagaagcccatgtcagccatcggcagcactttgtggaacacgtgagcgatacctaccgccagcgttggtgcaccacctgcacggttcaggacagaaggctcaccaatgtctttcgcggtttgcaggatctgctctggcgaaatcacgaagccccaggagctgacggtcgctgccgcgtgtgcggtaacgtctttcagctgtgccatgatgatcggcgcgttctcgccacccatttcatgcaggttaggcatggtgatgccaaggccagcaggcggggtgttcatcgcgaagtaaagacccggttcgatgatggacgcagcaaccagcgccataatcgccacgaaggactccatcagcattgcgccgtagccgatgaaacgcgcgtcggtttcattagccagcagtttcggcgtcgtaccggaagagatcagcgcgtggaagccagataccgcaccacaggcgatggtgatgaacaggaacgggaacagagcgcctttccacagcgggccagtaccgtcaatgtactgggtcatggcaggcattttcagttccgggttcagcaccacgatacccagcgccaggccgacgataacgccgattttcaggaaggttgccagatagtcgcgcggtgcgaggatcagccacactggcagcagtgcggaaacaaacgcatagccaatcagcgcgaaggtaatggtggtgtctttaaaggtcagtgccggaccccagtacggatcgtgagcaatcacgccaccgaagtagatagaggcaaccagcagcacgataccaatgacagagacttcacccacacgccccggacgaataaagcgcatatagatacccataaacagcgcaatcggtacggttgagcaaacggtgaagaccccccacggactttcggccagggctttaaccacaatcagcgccagaacggcgaggatgatgatcatgattaagaaacagccaaacagcgcgatagtccccggtactggtcccatctcttctttgatcatctcaccgagagatgcgccgttacggcgagaggagataaacagcaccataaagtcctgaaccgcaccggccagcacgacccccgccagcagccacagcgtgccaggcaggtagcccatctgcgcggcgagaaccggacccaccagcggaccagcaccggcgatagcggcgaagtggtgaccaaacaacacgtaacggttggtcggaacgtagttcagaccgtcgttgttaataaccgcaggcgtcgcgcgcgtggggtcgagtttcattaccttctgggcgatgtacagactgtagtagcgatacgccaccagatacaccgacacagaggcgaccacgatccacagggcgctgacgtgctccccccgacgtaatgcaactaccgcgaggcagaatgcaccgatgattccgagaatcacccagggtatgtgcttgaatatctttttagtatccatagtaaaacctggcatgtattgattaatagttggccgaagccgttctaggtttgcgttgcgtttgaggaggtaaattgaccgctatcctgcagtgatgttgccagagttacgcgcgcgtaaagtaaggtaaataactgagtggttattttagggacgtaagcggtcaggaatggcggtgagcggcaaaggcgtcgtttaagtgaccataaatatgtgatttatatcacatatttatattgcgaataatttatgtaaataatggctttttaaattcagggggtgaataaaattactcggcgtcatctccgcgggattttcataaagtttttcctttccaggccgaaaatcttgcatcggtccacaggaaagagaaaccatgttaaaacgtatcaaaattgtgaccagcctactgctggttttggccgtttttggccttttacaactgacttcaggcggtctgttctttaatgccttaaagaacgacaaagaaaatttcactgttttacaaaccattcgccagcagcaatccacgctgaatggcagctgggtcgcgttgttgcagacgcgtaacaccctcaaccgcgcgggtatccgctacatgatggatcagaacaatattggtagcggttcaaccgttgctgagctgatgcagagtgccagtatttcgctgaaacaggcggaaaaaaactgggcggattacgaagcgttgccgcgtgacccgcgtcagagcaccgccgcagcggcagagatcaaacgtaattacgatatttatcacaatgcgctggcggagctgatacaactgttaggtgcaggcaaaatcaacgagttctttgatcagccgacccagggatatcaggacggtttcgagaagcagtatgtggcttacatggagcaaaacgatcggctctatgatatcgccgtcagcgataacaatgcctcctacagccaggcgatgtggattctggtaggcgtgatgatcgtcgtactggcggtcatcctcgccgtctggttcggtattaaagcctcgctggtcgcgccaatgaatcgcctgattgacagcattcgtcatattgcaggcggcgatctggtgaaaccgattgaggtggatggctctaatgaggtggggcaactggcagagagtttgcgccatatgcagggagagctgatgcgtaccgtcggtgatgtgcgcaacggggccaatgccatctatagcggtgccagcgaaatcgccaccggcaataacgatctctcttcgcgcaccgagcaacaggccgcttcgctggaagagacggcagccagcatggagcaactgaccgcaacggtgaaacagaatgccgaaaatgcgcgccaggccagccatctggcgttaagtgcttccgaaacggcgcaacgcggcggcaaagtggtagataacgtggtgcagaccatgcgcgatatctccaccagttcgcagaaaatcgccgatattatcagcgtaattgacggcattgccttccagaccaatattctggctttgaacgcggcggttgaggctgcgcgtgcgggtgagcaaggacgcggttttgcggtggtcgcgggagaagtgcgtaatctggcccagcgtagcgctcaggctgctcgtgaaattaaaagcctgattgaagactcggtggggaaagtggatgttggctctacgctggtcgaaagcgccggggaaacaatggcggagattgtcagtgccgtgacccgcgtgacggacattatgggcgaaattgcttctgcttctgatgagcagagccgtggtatcgatcaggttggcttagcggttgctgagatggaccgggtaactcaacagaacgccgcgctggtggaagaatctgccgccgccgccgccgcgctggaagagcaggccagtcgcctgaccgaagcagtggcagtgttccggattcagcaacagcagcaacagcagcgtgaagcatcggctgtggtaaaaaccgtgacgccagctacgccgcgcaaaatggccgtggcagatagcgaggagaactgggaaacgttttaacgtaatgatgccggatgagtatttcatccggcgtttttattattaaaccaggaacagtgaaatcgccgggatatatgtcaccagcattagcattaacagtagagccgccagtaggggcagggattgtttaaagaaatttcccaccgaaacttgcgtgatattacataccagcagcatcacggtacctaccggtggcgtgaatgcgccaatcgacaggttgaagatcatgatgatgccaaaatgcaccggatcgatgccaaagtgttcgaccaccggttttaatagtggtaccaggatcagcaaaatggcgtttccttccagaaacatccccagcgtcagtagcaatatgttgataatcaacaggaacatgtatttgttttcggtcagcgaagtcacaaaattcgccactgcgacaccagcatgttccattgagaaaatccatcccaatgcggcgctggccatgattaccagcatcaccgatgcggttgcgcgtgccgtttcgcccaatgctttgacgacatgagaaatccgcatttcacgatagataaaaaagccaatcgccagcacgattagcaccgctactgcacctgcttctgttggggtgaaaatgttagcgcgaataccacccaccacagcaaaaatgaggaacagcgcaggccaggcctgtcccagcgagaacaccacctctttgcacgtaggccagctttcacgcgagggtttagcgttagttttgcgggcgacaaggtagacggtaaacatcagtacgactgcgcatagcaaaccaggtaccagtccggcgataaacatttttccgatagagacgtcggcaaccagaccgtaaataatcagggctattccaggcggtatgatcggggtgactaacgagccaccagcggtaatggcggcggcaaacgcgcggttgtagcctttacgctccatctccggcaccatcatgcgcgacagcatcgccgcgtcagcaaggttagaggcgctgacgccgcccatcatggtgctgacgagaatgtttgccacgcccagtccgccgcgcattttccccaccagaacgttggcaatgtgcaggatgcgttcggcaatgccggtgtagctcattagtgtgcctagcaagataaaaaacggaattgccagcaatgatgggctttgcgttggcgcgattagtctttgcacggcaatttcaatcggtacgctggagaagaataaaaagtaagcgatgatgccaataaacatcgccagatagacccgaatgttgagaaacaaacagacgatcattagcggaataatcaataaccaactcattgcattttgtctccgctatcggattgttttgtatcgtttattaaccagtagagggtataaatagccgttgccagtgcgccgacagggaccgccagatcgatccagaaccaggaaaccttcagaatttgtgtcactttaaactgcgccatttcggctagtcggtagcccagccaggccatataaagcagcagtgcgatggagagaagggcgaccagtactgcaataacacgcctgagtttgcctggaagcatctccatcaggaagggaatggtcaggtgcgccctgtcacgttctgccaccactccacctaacatcaccacccaaatcatcagcattcccgacatttcttctgtccattgaagcggttggccgatgaaataacgcataaataccgctccaattgtcaccacaaccagaacgaatagcgcaaaggcagcactaaattctgccactttgccaaaaagacgcatgaaacctcctgttagtgcgtgtcctgcctaagagagatgaggcaggacgctgagcattaatgcttattgcagttgctgttgaatggtttcgtacagacctggtgtccattccgggaattgagagtaaacttcgcgtgctttcttctggaatggtccagtatcgggatagatcacttcgacgccggctgcctgcatggttttcaacatttcggcatcacgctcaagagtgagtttctggctatagacacccgcttcatagccggtctggtggatcatctccagttgttctggtgaaagggtgccaaagaaggcttcaccacctatccacactgaggtatttgtcaggtagttaaccattgtcagatatcttgcctgctcatacagtttttgcccttgcagcactgaaattgggttttctacgccgtcaataacgccctgggttaatgcgggataaacttcgcctaatggcatgggagttggtgttgcccccatcgcctgaatggcttttatttgcatgacgttattaggaacgcgaatttttaaacctgcgagatcgtcaacggtgcgaatgggttttttcgaaataatctgtcgagtgccatagagataattattcattaccacatgaattccctttttcttcagactttcatttttttgtttaaaccagtcgctttcatatattttgaacagtttttgcggatcgtcagtcagatacggtccaaacaaaatccccaaatcgggttcataatcggcaagaaaagccacatcactcaaggttatgacattcatgcccattatggcttgctcggtgacatcctgttttgatcccaattgggagctgggatagagcgcaagtgttatttcgccattactttttttatttaataggtctgcccagtaacgcatgaccacatccaggggttctccagggttattttcataggcaacttttattgaaataggttttgcctggattattgacggtaaaaaaagggtactgacagtaattagcatcgctattattttgctcatctttacttactccatgctaaggaaataaaactccaacattgttgtcgggagtgaaaccttatgaaaaagcagtcattactgaaaagtagtcagcgaatagcagaatggctgcagatgtatcataaattcgtgcaccgggtaatactttgctgcttttaatcggtttttaatgcattttttgattgtatatcttaaagttatgtaatgcatgacgttacaaggaacaccctctgatgagtttagttatcgctgataagatctcttattcggttgatgatttattaaaaataaaatcattaatttggctgcggttatttttaattgtcaatacagataaaaactaagtgttgacgcagaatggtggtatccattaaatttatttagtgctgatttaatacatttgctaaacgtataattcatgctgatgttaaaagaaagccgtcatgcactaaataacttgttcggcaaggaaatcagagagtaacggatgattcgttacaacggggaaaggcagtaaatattcacatggtgaatttgttatcaacttgaaaacttattttactgggttccttctgatcatgtgagtgaacgcagtgattaatgattaacgttaagtgctaaccagagcgctttttatgaaattaaattaataatatccattatttatgaatgaggaagcctgtttattatatggaaatacttttaacaattttaattcttacgttggtagtatcattaaccagcgtgcttacacgtctgtctcctgtccagataccacttcctttaatccagattgccgctggtgcagtactggcccagcctatatttggtctgcatgtggaattcaatcctgaactttttctcttattgtttataccacccctgttgtttgctgaaagttcaaaaatacaacctaaagaattgatcaagcacagccgggaaattatcagcctggcacttttgttggtactaatcactatttttggtgtcggctatgtgattcatttactcttaccgaatgtgccgctcatcgctgctttcgcattagccgccgtgttgtcgcctaccgatgccgtggcgttgctggggattgtcgggaaagggcgtatcagcaaaaacatccaggaagtgctcgaaggcgaagcgttgatgaatgatgcttccggcctggtggcgttgaaatttgctgttgcagtgacgatgggaacgatggaattcagcgttcatggcgcaaccattgcgttttttgtcgttgcgttgggcggtattgccgtggggatcgctgttacctggttatatggtaaagggctgctgttgatcagccgatatgctcacgatgaaccttccattcagattgtattgatgcttctgttgccgtttattgtttatctggttgcggaacattttggcttatctggcattcttgccgctgtcgccgcggggttaacaaccagtcgcattggcgtagtccaccacgcgcctattcgcctgagaattaaagctaaaagtagctggtcgatgcttgaatatgtctttaacggcatggtgtttctgattttaggcttacaactgccgggcattatttcggaatcactgatccgtgcagaaaacgatccactggtggacaccggatcgctgctccttgatgtcatttggatctacctggcgttaatggttgtgcgcctgggctggctttggctgatgcgtctgtatagccgtaaacgacccggcaaacatccgatgctgtttgctggatataaaacgcgtcatatgctgctggcgacctttgcgggggtgcgcggagctatcacgcttgcgggggtgctttctatcccgttattgctgccggatggcacaccttttcccgggcgttacttgctggtatttctcgccacaggtgtgatcctcttttcgctggtttgcggcattattattctgccgttattactggggaaaaatgtggggattttcagcgataaccgacaaaaagaagaggaagctgccgatctgtttatggctaaaatggccatactgagtgtgcaaaagaccgagcaacgtttgctgcgcgccagaacagaaaacctcgataacgagttgattatggaaacgggggccagagttatcggttatatgcgacatagtgaagaggatatgtcgcctaatgataattccctgcatatgcagcgtgcgaagctggaaagaacatttaatctggcggcgttaaatgccaaacgcgcggctatttaccagatgcgcgcaaggcaagaagtcagtgatgaaacactggcaaaaatagtcagtgaattagatgtgctggaaacgttaatcatggatagccgataattttatcgctgtcagtaatagggagttaaatgatggctgagagtaatacttccagcatcgtttattccctatgtatttccttatgggcagaacaatcgcctggattaatactgcattaatacaacatagtgatataaaccaagaatcaatgtttttaatctgtacttaatttatcggtgatgttgcctgatggaacgaatcattgattgtttggcggtatccagatggtttcgcaacgccgttattgcatctaaatcgctacggcaaatcagggcgctgagaatggtcatatgttcatcaacagcaatgatattgcgctgtttgagatcgctttcatcccattgatagtgaaaatgaaagatcaccgatataatttcaagtgattgattaaaaaagatgttgtcagcagcggataacagcatggcatgaaaatcacggtctaattgagaaaacattcgaaagttgctgccaatgctgtcgcgcagcgtccggtggcgttcgagcatggtttttgcttgcagccagcgagggtcatcatcgggaaggttgagaaagtgttgcagggaatgtgtttcgagcattttgcgtagctcaaacagctgctcggcgtaggattgatcgaactgcttcatgctccattggccgcgcttttcgctttgaataagattataacgaccgaatttcaaaagatattctcgtaccactaccggactgacgcttgccgctcgcgccagctgaagttcggaaaagctttctccggcgcgtaactggcgcaggttaatcatggtgaaaaatgcctgctcgaaaagacggttttgctctttcagcgaggccgtgatgcaatcaaatccatcgttctgttcgggtttgcgggcgataacataatttttccccaccagggtgagcacgccacatgcgcttaaatgctggagtatgtggcgtaccgtagtgcgactgatgttatacatttctgccagtccgctttgtgaaggcagcggagaaggaatattgcccctcgccatatcttcaatcacctgatttatgacgctatgacgtaaattctgcgaacgactcattcttccctccagtccggcattaaaagccgatttaaaacatttttatgcgcgatcatccgcatattttatgggtaaattcaggcgctcttataaattcgacgatatctgaaagtcataaaataaaaggagcggtgaatcatgtccacaatgaaagtattaatttgtcaggaaataaagaatttagtatgggaagtccgggaaagaccggtgccaggcgataatgaagcattaattaaaattaaaactgtcgggatttgcggtacagatattcatgcctgggcgggcaatcagccatttttcagttatccacgcgttttaggccatgaaatatgtggggagattattgaatcaggaaaaaacattcacaattttaatatcggacagcaagttgcggtaattccgtatatttcttgtcagcaatgcccggcgtgtaaaagcggtcgtaccaattgctgtgaaaaaatttcagtcattggcgtgcatcaggatggcggttttagtgagtatttgagcgtgccggtggcgaacattttgcccgcagacggtattgacccgcaggcggcagcattgattgaacctttcgctattagcgctcatgcggtgcgtcgcgcagccattgctcccggcgagcaggtgctggtggtcggggcggggccaatcggtctgggcgcggcggcaatcgctaaagccgatggcgcacaggtggtggtggcggataccagtccggcgcgccgtgaacatgtagcaacgcgtctggaattacctgttctggacccgtcagccgaagattttgacgcgcagctgcgggtgcagtttggtggttcgctggcgcagaaagtgattgacgcgacaggtaatcaacatgcgatgaataacaccgtaaatctgattcgtcacggcggcacggtggtatttgtcggcctgtttaaaggtgagttgcagttctccgatccggaattccataaaaaagaaacgacgatgatgggcagccgcaacgccacgccggaagatttcgctaaagtcggtctattgatggcggaagggaaaatcactgccgacatgatgttaacccatcgctatccgttcgccacgctggcagaaacctacgagcgcgatgtgattaacaatcgtgagttgattaagggcgtaattactttctgataaggcgagattattcaagttgccatgcagcgtccggggaagtgttgggcgctgtttttttgtttcttaataatgtgttgtaagccggagaaggcgtgtaggtcgcaccttatgcgacctacacatcagtcaggaattacccttcacgttctaccactttaatttccaccatgccgatcccgagcttacgcggcgagtgtccgaggatattcccttcgttggttgagacaggttccggcggcacaattaccagtgtgtcggcatcggttgggttatcgaaatgcagtgtggtggtggtcacttcattgcccagcacaagggtttgttcttcattgcctacgcgtaccggaataggacggctggcgttattgccgtatgctttggcggtaatcaccaggtcaaatttcttcggcagcggatgcttgtactcgatttttacttcatcgcccagctgtgcgttggaccagcggccccacgactctggacgagaaatcccgctaaactgtttcacctcttctggcgcaccagcgacgttaaagatgaaactgtcggctttgtagcgaatatcgttatcaacaatctttagcgtatcgacattgcctttgtaacgcgccatgtcgatgaccgtatctttaaatgccgttttgcccttccatattgctttgtcaacatgctgaacaatttgctgaccgccaagctgcccttgcgagacacaccagtcggtggagagtgccagttccggagcccagagttgtgccatcttgtagcaacggtcaacccagacgaaattgtcgcgtggagcgaaatctgccaactggaaacgcagcggtgctgagtattcgctttccggcagcggttccacgcgtttgtctgaaacccgcaacagcagcggcaaacggaaatggctacctgagaaggcaatcatgtttttctgctggtcgatggtgaactctttcatctctttagggaatttccacaggcggatgatatccggcttccacgccaatgttttctctttgatattgaggaagatttccgacatcgactgcccggataaactgctacggccaagtccgagatagttatcgccaccgagaatgtccagcaccgtcgcgccgttatccatcgtattacgcttcactgccagcgtctcttgctgcggcttgtcgccacggatgacaaaaaacaggttattgcgatcctgcttattaaggtatttccacgccgtattgttcatcgctaaatggtcagaagagacgacgattacggtatctttaaaccacggtgacgctttgattttgttgataaacgtcgcaatattctcctggctgcaacttaccgcgctgaatgactgattcggcttaccgtcaaaatcatattttttgcggttacaggtgcgcgagataaaaccatccgggtgatgggtatcgactgtcagggtaaacagtgagaatcgctgacctgagcgggaaagctcttcaaattttttccacgcttcatcgagaacggtatcgtcgtagaatccccagtcgttgcgatagtgcgggtcggccaccacgcttttcagctcttctgagccgtataagtggtcgaagccgtgcgatttcaggaacacatctttaccggcaaaacgcagattcgcgccctgcacgaaatagttctgataacccgagtttttcagaatatcgcccagacagatgttctgcgggaagaagctggagacagaggcggaggcgttgccttcaaatggggcaaacagcggtatgccgcactgagaagctaccatgcccgcaatcgtgtaatccgttcccggcagctgctgcgtgtggctgaaatccaggccttcatttttcaacgcgcccagttcaggcgtgagatccgggaaagcctcgttatcaaaataggtccgctcgagactttcgccgtagatataaaccaggttgagtttcgggtcagggatagttctcgacggctctttataataagccgcaaagtccgggtcgccgtcgcgtgactgggatttcaccagttccgttatctgacgaaatgccgggctggcatccactgaacccagcgccagtaagagtgccagcaggctgtaaccaaaatggtgcggatgatggcgacgacggcgcaggatccagcccagcgcaccgaacaccgccgccagccccagcacaatgccgataccaggcaggatgtatttgctgacaccagcaccggtcaggctgttggttaaggtatagagaaccgcgtcgttaataccatcgccagtaaaatagtcgctggcaaacagggtgatatttaaaacgacaaatagccccagtaccgttaatgtggccgcaaaccaccaggtgttacgtcccgctttccatgcgtaaatcagcacagaggcgagaaaaagggcgaaagagagtagttctgacaacgggcgatcctcactaaaccgggccgtttagccaacgtttaagctttttgagaagcacaatgtaatggcgtcgccatattgctgcaattctagtgtcaaaaaaatgcgatgttgttaggaattagtttataaacagacttttttgatcgcggtcgcttcccgtgtaacaggggtaaaaccgtccaggagcagggaaaagggcaggagagagccgcgtcagccgggtaacagctaaaacgcggcgtttcgcggttcaggaaatgaagttcagcccctgctttaacaccagatcgcaggctttggttttcaccttttctgccagcggagtcgttccaatattatccagattgagttgctgaccatctttggttttcagcaaaccctgaatgccatccagatagttggtgtcttctttttgctcttcactgttcaggcccagtttttccagtacctgattcttgatgttttcggcatcggttaccgaagccagcttttgcttcgcgcagtattgcagaatgcctgcggcgttgttcatgttatctgcgcttaaggcctggttcccgctgctaagcaagttagttaatgacgcgagcgaccaaccgccttcctgtgtcgtgttgttttggttgccaagttcgctggcggcgctggagagcgcatctttccaggacgcagcatgcaccccggtggaaattaatgcgctggcggcaatggcacagcacagaagatgtttaatagttttcatcatcattactcaaggttgaattgtgtcgcagtataccgccagaaacggggattaatactctttacctgttacacggctacggtagctatcccagttgaagatcacccacaaactgttacccaggcgcatacggtccatcacgcgttcgcccagcaacttggtcatctcttccatattactgttggtcagcatcccggttgggcgtttggaagaagagcggcgatcgacgatctggttaatgatcactttttcgtatttcgattcggtctgcacgccgatctcatcgatcaccagcagatcaacgttactcagatcgttaagcagttgttcttcgctggtaccgctattcctgaaggtatctttcatcgccgacataatatcggccacggtgatgatcaatacggatttaccgcgtagcagcagctcgttgcagattgccgccgccagatggtttttgccggttcctggcttaccagaaaagatgaagctggcgatgttgccgtcaaactcctcgacatactggcgcgctttgcttaacgcattcatttgtccttcacactcaacgcgatagttctcaaaggagcagttctgatgcagtggacgaataccggagcggttaaaggtgcgctgcattttcatcgcccgattttcacgttcgagagcggcggagcggatcgccccttgttctttctgccaggccagtagttcttcacccgttttgaaagcaggtttgatatgggcaggcatcattttttgcaggcgttgcatcaagtcgccaacgtttttcatcgttaccctctgaatcctggtggaatttggctgtcaggttcactgaccgtattcacatctcgtttcggcagtccgccgttgctggcacgaccgatttgcaggctgcgcgccagtttttgttgccactgcacatggtgaaagactttgccttccgcctgccagtaggcaatgaatgacgccagttcttcggcggtcaccggctctcttagtgccacgccccatagcgccgccaggcggataaagtcggcatcgggttgccagtccggatacatggcaaatttccccatgggtacggcaacgggagcggtttgcggttcctgatagagttgatcgtccagggccacgtcacttcccggacgcgccagcttttcttccagcgccagcagttcagccaggcgtgcaggcgtgacggcataaaacgccggggcgttgttgtcaaatacggcaaccacaccgccttcagcttttgccagaacggtttggtgatcgtgtaccagggcgtcaataccaacgacgtccggggtcaaaactctggaagacatactgtttctcaaatatggaacgatgaacgagaagggagataacttttatagtaacacacggaggagaggaggctgtctctcatccgcgtgctttaagtgaggcaattttatacgcgagggcgcttgcggtacaaccataatccaggaatggaaagaccgatggataacgcaccaacaatcgatgaagctgtaagaaagttggttaacagggtaatcatcaacggttcgctgtaacctagctggctgatttttaccgccgaaatcattgcggtataagctgatatgccagggaacatagggataacagccgccacggtaaacactttcggatgcgccagataccagcgcgaccattgaataccaatggtgccgaccagcatagaggccataaaggttgaccattcaatattcagcccgctggtcattaagatcattcgggaaccatgacctatcgcaccaagcagcgcacaccagcgtaacgctcgaacgggaacgttgaacaccatcgcaaagccgaccgcaggaatggcggcgaggatcatatcctgcgccaacgctaacagaaattcgatcacacccatccgcgtagcccccaaatcgtcagtgccattactacgccgacacaggtagccagtgtcagcagactggcgattgcccagcgtgccagtccggtattgatgtggcctttaaacatatcggcgacggcatttatcaacggaaagcccggcaccagcagcagaacgctggcggccatcgcaatggtgggggtattgctgaaagtgggaagttgcaaaagcaatccggaaatggtggtggcggcgaaagcggtgaggcaaaagttgatctgtggatgaagatgacgttgtgccagcagctggcggatatacatcgcggccgtactggccaggaaggtgatgacggcaccatcccagccacctttattgagtttacagaaacaggcgcaggaaaggccaaccattaaggctaccagccatcttgggtaacgtaatggctgaatttggctaaatcgtttctctacgcctttgtaatccagcagatgatgctccgccagaattacaatgtgctggacttcagtcaccacatgcatattaatgccgcgatcgtgatttttacgtgtcgatgtcaggcattgcccatctttaatggttgtcagcacgatggcgttcgaagagatagaactctcgacgctgtccattcccaacgcccgacccagtcgtgaggaaagctcatcaaccaacgcgctttccgcaccatgttgcaaaagaaataatccacactggatacaaagccgtgttacggctcgctgttgctcagtttgcataactcgccctttgtcatagacgtgctgcgtattgttcagataatgagaatccatttgtatcatgaagcacggttgttttgcggtaggttaagatcaaaattgcgctgattaatcctggttatcgggagatgctcggtgataaaaagcgaattatctctcgccgtaaacaaactatcgcatgaatattatcactataatgaatttgttatttggcctttacgagtcaggataatagatagctgggcgcgtttttttatgttaacaagttaaaaccatcagattttattgaataaatattgattgtgtgattcccgcactctgcgggaagagatattatttaattataaattaaatgaatgagatttctgtttttcattaagtatttctaacaacttaatgtagatattttaaatgtctccaggctatttcaccaggttatcatttgatgctaaccttctgacacatgcagtggagttgttgtgcagcaggagtatgctgatatgaaagtgaatgctaaggataatttattcgcttaatctattaatttgctggaaatatttaaggaatgaatgccttgaataaaccatcatgatttttagacagtggatgtgggtaatgctgccaacttactgatttagtgtatgatggtgattttaaggtgcttgcgtggcttccatttccatcagatgtccttcctgctccgctactgaaggcgtggtgcgtaacggcaaaagcactgccggacatcagcgctatctctgctctcattgccgtaaaacatggcaactacagttcacttacaccgcctctcagcccggtacgcaccagaaaatcattgatatggccatgaatggcgtcggatgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacagtggggctacgtcggtgctaaatcacgtcagcgctggctgttttacgcgtatgacaggatacggaggactgttgtggcgcacgtcttcggtgaacgcactctggccacactggagcgtcttctgagcctgctgtcggcctttgaggtcgtggtatggatgacggatggctggccgctgtatgaatcacgcctgaagggaaagttgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaagttggagtcattaccgtggatgtggaggaaatatgttgccaggatgctgcaaaaatggaattgttatcagtaaaatacctgttatgcaagcagggttaaaagaggtcatgaggactcacttccctgaatatgaaataatatccagcgcctctgcggaggaccttaccttattacaattacgtcgttccggattagtcattgctgatttggccggtgaaagtgaagatccacgttccgtttgtgaacattattattctttaatctcacaatatcgggaaattcactgggttttcatggtgtcacgctcctggtattcccaggcagtagaactgctcatgtgccctacggcgacgttattgtctgatgttgaacccattgagaatctggtcaagaccgtacgttccggcaatacgcacgcagagcgtatcagcgccatgctgacctccccggcaatgactgaaactcatgattttagctatcgctccgtcattctcactctttcagagcgcaaggtactgcggctattaggtaaaggatggggcatcaaccagatagcttcattgcttaagaaaagtaataaaactattagcgcccaaaaaaacagtgcgatgcgtcgactggcaattcacagcaacgctgaaatgtatgcatggataaatagcgcgcagagtgcaagagaacttaacttgccttctgtttatggagatgccgcagaatggaacacagccgaattaagaagagaaatgtcgcactcatagaaaaatgcgtcatgagtagtatcggtattgagagtttattcagaaagtttgcgggtaacccttataagctccatacctataccagtcaggagtcatttcaggatgccatgtcgcggatctcgtttgcggcggtcattttttctttttctgccatgagaagtgcgcgcagagagggattatcctgcctgactgaactggcgattaagtttccgcgtacccggcgtttagttattgcggatgatgatattgaagctcggctgattggttcattgtcgccatcaccgctggacggtgtattaagtaaagcgtcaacgctggagatttttcatcaggaactctttttgtcattaaatggtgtacgtcaggcgaccgatcgactgaacaatcagtggtacattaaccaaagccggacgttaagcccgacggagagagaaatattgcgctttatgtcgcgtggctactcaatgacacaaattgccgagcagcttaaacgcaatatcaaaacgatccgtgcacataaatttaatgtgatgtcgaaactgggcgtcagttctgatgcagggttgttggaggccgcagatattctgttatgtatgcggcattgcgaaacaagtaatgtgttgcatccttattaatccgcatgatgccgggtttacttccccggcagtgctttcatttcagcgtacaatcgccacattgctgcacatccggtaagcgataacgctggcagcaagtgcggcgcaccagcaggccgtcgcgtagcaccacggtacgccagagtggattatcttcaccggtagtaagcgttttctcaaaaaagagggcatagcgcagcgattcaaccgtcgcctcgccgagcagctgtttcatctcagtcagataccagttgatcaaataaccggtattgctccagataagtttgccgttaatctctcccgttgcttctagtgcctgcacaaccggaaccagcgcctggctgattaacgtttccattcgctgctgcggcgaatgtagtgttgcgtttttatcttcacacacatcgacccagaaacaggcggcgcgtccggtttcgtgaaactcaacgtggacatgttccggcgacacatctaatgctttttcctgagtcagcagcgccagcattaatggtggtaccatcaggccgatataccattgcgcccacagtgagataagcggtttgttttcgcggatcatcaaaggttggttgcggtagatatgatcggaatagaccgcgagtagagaacttagcgcattcggtgatgaccattgcgccagcgtcatggcgttaagtggggcgggttcatccaggcggataaactccagcaaatgttcacgatgttcggcgatcgttgcccgcacggcttgtgcaagcccagcatcctgcggctggagatgcgttcgccagataacatcttcatagagcggtgcggaacgataggccataatcgtgatagtaatctaaatgataattattgctaatcctatcgataggtttacccgatagcaaggaatttctctggcttgcaaatgataaaaattatcatatgatattagttatcattatcaatgaaagagatgagaccatgttgcaacgtacgctgggcagtggctggggagtgttgctgccgggattgctgattgcagggctgatgtatgcggatttatcgccggatcaatggcggattgtcattctgatgggattggtattgacgccggtgatgctgtatcacaaacagttacggcattacgttttgctaccatcgtgcctggcgcttattgctggcatcatgctgatgataatgaatttgaatcaggggtgataaaacagtgaagagacaagaaaagaagtaaagataattggtgcgaggggggggacttgaacccccacgtccgtaaggacactaacacctgaagctagcgcgtctaccaattccgccaccttcgcacagtcatcttactttttttgatatcgcctcgtttggtgcgaggggggggacttgaacccccacgtccgtaagaacactaacacctgaagctagcgcgtctaccaattccgccaccttcgcccagtgcgagcaatatcaacgtggtttttggtgcgaggggggggacttgaacccccacgtccgtaaggacactaacacctgaagctagcgcgtctaccaattccgccaccttcgcataccatcaattcttaaaaagaattgctaccacggaggcgcattctagtggttttcagcttttcgtcaatagttaattatcgacagaggtgtaattgctggaaaaatatccatcagcggattgtggataattcgtttgtcggtcagataaggcgtgtacgccgcatccgacacggtatgcggcgacatatatcagatactcaacctttcttcgcctggcgggtcataatggcgcgatacaccttgaagcgcccggtttgcgcaatcacttcgtggaaaccaaatgtctcatccagcacgtccgggtaaggcaggaaggcgttcgctacaattcgcaactcgccgccgctgttcagatgacgcaccgcgccgcgaattagcgtttgcgccgcatccaggctggtttgcatcccatcgtggaacggcgggttggagattatcatatcaaagcgacctttcacctcggaaaagacgttgctggcaaagacttcaccttcaacaccgttggtcgcaagtgttgcgcgactggcttctaccgctggtgcagaaacatcacacagagtgaggcggatcttcggtgaatggcgcgcaaaagcaacggaaagaacgcctgcgccgcagccgacatccagcactttacccttcgtgtgtggagttagcgtcgagagcagcaactgactgccgacatccagaccgtcgcggctaaacacgcccggcagcgttttgaccgtcaagccatcgacgctgtattcgccccagaatttattggcatcaaataccggctgcttttccagacgaccaaaatagaggccgcagcgacgggcgctgtctaccttattcaacggtgcataatcggccagcatctgctcggcgctgcgcacgccgctgcggttctcgccaacgacaaaaatatccgtgcccaccggaagcagagaaagtaaattcatcaactggaactgggcttccggtttgttcttcggccagtagtagatcagcgtatcgcaatctgcgacgtcatctgccgtggcgaccaggctaaaacgggcgttatcccccatctggcggcttaacacctgccagtggtggaattgctgggtatgagcacggctggccgcggtatctaaacgcgcgggcaggtcatcctgtaagtctccggcaaacagaatacggctttgttcgaaatcatcactgtgacgcagcaagacttcacttgccggggtaaatgcagacatggaatgctcctcaattgatactggcggcgattatagccatatgttggcgcggtatcgacgaatttgctatatttgcgcccctgacaacaggagcgattcgctatgacatcccgacgagactggcagttacagcaactgggcattacccagtggtcgctgcgtcgccctggcgcgttgcagggggagattgccattgcgatcccgccacacgtccgtctggtgatggtggcaaacgatcttcccgccctgaccgatcctctggtgagcgatgttctgcgtgcgttaactgtcagccccgatcaagtgctgcaactgacgccagaaaaaatcgcgatgctgccgcaaggcagtcgctgcaacagctggcggttgggtactgacgaaccgctatcactggaaggcgctcaggtggcatcaccggcgctcaccgaattacgggcaaacccaacggcacgcgccgcgttatggcaacaaatttgcacatatgaacacgatttcttccctcgaaacgactgatttaccagcggcttaccacattgaacaacgcgcccacgcctttccgtggagtgaaaaaaactttgccagcaaccagggcgagcgttatctcaactttcagttaacgcaaaacggcaaaatggcggcgtttgcgattacgcaagtggtgctggatgaagctacattgttcaatattgcggtcgatcctgactatcagcgtcagggattgggaagggcgctgctggaacatctgatcgacgaactggaaaaacgcggcgtggcgacgctatggctggaagtccgtgcttcaaacgctgccgccattgccctgtacgaaagtttaggctttaacgaggcgacaattcgccgcaattactaccccaccacggacggtcgcgaagacgccatcatcatggcgttgccaatcagtatgtaagacaaggtggaataatgaagtgggactggattttctttgatgccgatgaaacgctgtttacctttgactcattcaccggcctgcagcggatgtttcttgattacagcgtcacctttaccgctgaagattttcaggactatcaggccgttaacaagccactgtgggtggattatcaaaacggcgcgatcacttcattacagcttcagcacgggcggtttgagagctgggccgaacggctgaacgtcgaaccgggtaaactcaacgaggcctttattaatgcgatggcggaaatctgtacgccgttgccgggggcggtttccctgcttaacgccattcgtggcaacgccaaaatcggcatcatcaccaacggctttagcgccttgcaacaggtacgtctggaacgcacgggcctgcgtgattacttcgatttgctggtgatttccgaagaagttggcgttgccaaaccgaataagaaaattttcgattatgcgctggaacaagcgggcaatcctgaccgttcacgcgtgctgatggttggtgacactgccgagtccgatattctcggtggcatcaacgccgggcttgcgacctgctggctgaatgcgcacaatcgcgagcaaccagaaggcatcgcgcccacctggaccgtttcttcgttgcacgaactggagcagctcctgtgtaaacactgattgcctcccccccgttgatgggtaaaatagccgcaatttttcgttttcaacaagcgcggcgcgatgccgcttactcaagaagaaagaattatgacgttgtctccttatttgcaagaggtggcgaagcgccgcacttttgccattatttctcacccggacgccggtaagactaccatcaccgagaaggtgctgctgttcggacaggccattcagaccgccggtacagtaaaaggccgtggctctaaccagcacgctaagtcggactggatggagatggaaaagcagcgtgggatctccatcactacgtctgtgatgcagtttccgtatcacgactgcctggttaacttgctcgataccccggggcacgaagacttctcggaagatacctatcgtaccctgacggcggtggactgctgcctgatggttatcgacgccgcaaaaggtgtagaagatcgtacccgtaagctgatggaagttacccgtctgcgcgatacgccgatcctcacctttatgaacaaacttgaccgtgatatccgcgacccgatggaactgctcgatgaagttgagaacgagctgaaaatcggctgcgcaccgatcacctggccgattggctgcggcaagctgtttaaaggcgtttaccacctttataaagatgaaacctatctctatcagagcggtaaaggccacaccattcaggaagtccgcattgttaaagggctgaataacccggatctcgacgctgcggttggtgaagatctggcacagcagctgcgtgacgaactggagctggtgaaaggcgcgtctaatgagttcgacaaagagctgttccttgcgggcgaaatcaccccggtattctttggtactgcgctgggtaacttcggcgtcgatcatatgctggatggcctggtggagtgggcgcctgcgccgatgccgcgtcagaccgatacccgtaccgtagaagcgagcgaagataaatttaccggcttcgtatttaaaattcaggccaacatggacccgaaacaccgcgaccgcgtggcgtttatgcgcgtggtatccggtaaatatgaaaaaggcatgaagctgcgccaggtgcgcaccgcgaaagatgtggtgatctccgacgcgctgacctttatggcgggtgaccgttcgcacgttgaagaagcgtatcctggcgatatccttggtctgcacaaccacggcaccattcagatcggcgacacctttacccagggtgagatgatgaagttcaccggtattccgaacttcgcgccagaactgttccgtcgtatccgcctgaaagatccgctgaagcaaaaacagctgctcaaagggctggtacagctttccgaagagggcgcggtgcaggtgttccgtccgatctccaacaacgatttgatcgttggcgcggttggtgtgctgcagtttgatgtggtggtagcgcgcctgaagagcgaatacaacgttgaagcagtgtatgagtcagtcaacgttgccactgcccgctgggtagaatgtgcggacgcgaagaaattcgaagagttcaagcgtaagaacgaaagccaactggcgcttgatggcggcgataacctcgcttacatcgctaccagcatggtcaacctgcgcctggcgcaggaacgttatccggacgttcagttccaccagacccgcgagcattaattcttgcctccagggcgcggtagccgctgcgccctgtcaatttcccttccttattagccgcttacggaatgttcttaaaacattcacttttgcttatgttttagctgatatcccgagcggtttcaaaattgtgatctatatttaacaaagtaatgacatttctgacggcgttaaataccgttcaatgcgtagatatcagtatctaaagccgtctattgtcattctaccgatattaataactgattcagaggctgtaatggtcgttattcatcacccatcgcttttgtgatggcgaccattgacttctgtagagggtgaagtctctccctattcagcaatgcaacctcgtgttgccaggctcaaattacgagcaaacatacaggaataaatcgatgactatgacaagactgaagatttcgaaaactctgctggctgtaatgttgacctctgccgtcgcgaccggctctgcctacgcagaaaacaacgcgcagactgccaatgaaagcgcagggcaaaaagtcgatagctctatgaataaagtcggtaatttcatggatgacagcgccatcaccgcgaaagtgaaggcggccctggtggatcatgacaacatcaagagcaccgatatctctgtcaaaaccgatcaaaaagtcgtgaccctgagcggtttcgttgaaagccaggctcaggccgaagaggcggtgaaagtggcgaaaggtgttgagggcgtgacctctgtcagcgacaaactgcacgttcgcgacgctaaagaaggctctgtgaaaggctacgcgggtgacaccgccactaccagtgaaatcaaagccaaactgctggcagatgacattgtcccttcccgtcatgtgaaagttgaaaccaccgatggcgtggtccagctctccggtaccgtagattctcaggcacagagcgaccgtgctgaaagtatcgccaaagcggtagatggtgtgaaaagcgttaaaaatgatctgaaaactaagtaattcgtcgtaattcgacctcccgaactttgtcgggaggcgcgatgtgcaccacactaaaaatatcgcattgagtgattttcacgctcatatcaagcggtgacattaactatggtaaaggagacgcttatgtttcgttggggcatcatatttctggttatcgcgttaatcgccgccgcacttgggtttggtggtctggccggtactgctgcaggcgcagctaaaattgtctttgtcgtcgggattattctgttcctggtgagtttgttcatgggccgaaaacgaccctagatttcagaccattaagaaaattttatccaaagccagtccagcggactggcttttgcggttttagcgaataataaattgcgttactttgtcattctttcacaacaaaaacaggaaggcagaggtggggcagcgaatacctgtaacgcttggtaatattgcgccgttgtcgctaaggccgttccagcctggacggattgctctggtgtgcgaaggcggcggacaacgtggaattttcacggctggcgtgctggatgagtttatgcgcgcgcagtttaatcctttcgatctttatctcggcacatctgccggggcgcagaacctctcggcgtatatctgcaatcagcccggttacgcgcgcaaagtcatcatgcgttacaccacaaaacgcgaatttttcgatccattgcgctttgtccgtggaggaaatcttatcgatctcgactggctggtggaggccaccgcaagccagatgccgttgcaaatggacaccgcagcgcggttatttgacagcggcaaatcgttttatatgtgcgcctgtcgtcaggatgactatgcgccgaattactttttgccaactaaacaaaactggctggatgtgattcgcgcctccagtgcgatacctggcttttatcgtagcggagtgtcgctggaaggtattaactacctggatggtgggatcagtgatgcgatcccggttaaagaggcggcaaggcagggagcaaaaacgttggtcgtcatccgcactgtgccgtcacaaatgtactacacgccacagtggttcaaacgcatggaacgctggctgggtgacagtagcctgcagccgctggtcaatctggtgcagcatcatgaaaccagctatcgtgagattcagcaatttattgagaaaccaccgggccagctgcggatattcgaaatttatccgccgaagccattgcatagtatcgcgctcggcagtcggattccggcgctgcgtgaagactataaacttgggcgtttatgtgggcgttattttctggcaacggtcggtaaattattgactgaaaaagcgccgctgagccgccatctggtgccggtggtgacgccggagtcgatcgttattccgcctgcgccagtcgccaacgatacgctggttgccgaagtgagcgacgctccgcaggcgaacgacccgacatttaacaatgaggatctggcttgatttgccgttttatcgacacccactgccattttgatttcccgccgtttagtggcgatgaagaggccagcctgcaacgcgcggcacaagcgggcgtaggcaagatcattgttccggcgacagaggcggaaaattttgcccgcgtgcaggcgttagcggaaaaatatcaaccgctgtatgccgcattgggcttgcatcctggtatgttggaaaaacatagcgatgtgtctcttgatcagctacagcaggcgctggaaaggcatccggcgaaggtggtggcggtgggggaaatcggtctggatctctttggcgacgatccgcaatttgagaggcagcagtggttactcgacgaacaattgaaactggcgaaacgctacgatctgccggtgatcctgcattcacgacgcacgcacgacaaactggcgatgcatcttaaacgccacgatttaccgtgcactggcgtggttcatggtttttccggcagcctgcaacaggccgaacggtttgtgcaactgggctacaaaattggcgtaggcgggactatcacctatccacgcgccagtaaaacccgcgatgtcatcgcaaaattaccgctggcatcgttgttgctggaaaccgacgcaccagatatgccgctcaatggttttcaggggcagcctaatcgccctgaacaggccgcccgtgtgtttgccgtgctttgcgagttacgaccggaaccggcggatgagattgccgaagtgttgcttaataacacctatacgttgtttaacgtgccgtaggccggacaaggcgtttacgccgcatccggccgttggcgcacaatgcctgatgcgacgctgacgcgtcttatcatgcctacaagtctgtgccgaaccgtaggccggataaggcgttcacgccgcatccggcagctggcgcacaatgcctgatgcgacgcttgacgcgtcttatcatgcctacaggtctgtgccgatccgtaggccacatccggcatgtcacaaatatagcgccggaaatattaaccggctcaccccgcgctcccgtaacgcatcagccagttgttccacatcctccggcgtggcgctcggccagctttgcgcctcgccatacacgccgtgggcatgaaacgcgttcaggcgtaccggaacatcgccaagtcccttgattaacgccgccagttcttcgatatgttgcaaataatccacctggccagggattaccagcaaacgcagttccgccagcttaccgcgctctgccagcaaacagatgctgcgcttgatctgctgattatcgcgtccggttaattgctgatgacattcgctcccccacgctttgagatcgagcattgcgccgtcacacaccgggagcaatttttcccagccggtttcgctcaacatgccgttactgtccacgaggcaggtgagatggcacagttgcggatcgtttttgatggcagtaaacagcgccaccacaaacggcaactgggtcgtggcttcgccgccgcttaccgttatcccttcaataaacagaaccgctttgcggacatggttaagcacctcgtccacgctcatggattgcgccattggcgtagcatgttgcggacacatcttcaggcaggtatcacattgctcgcaggcagccgcgctccacgccactttgccgtcgacaatctgcaacgcctgatgcggacactgcggcacgcactctccgcaatcattacagcgccccatcgtccacggattgtgacagtttttgcagcgcagattgcagccctgcaaaaacagagccagacgactgcctggcccgtcaacgcaggagaaggggataatcttactgactaaagcgcatctgctgttcatggcttatcacgcgcggctggcgttccagaatacgagtgttgcgtgcggcttcttctcccagccaggtagtgttggtgcgtgaaccttcggcgcgatatttttctaaatccgacaaacgcaccatataaccggtaacgcgaaccagatcgttaccgctgacattggcggtaaattcacgcattccggctttaaaggcaccgaggcaaagctgtaccagcgcctgcggattacgtttgatggtttcgtcgagcgtcagaatgtcgctgatgccggaataataataagcatgatgcggggcgacagtttgcagatgggtaatcggatctggctcatcgccatatggtaaacgcgcgcccggcgtggtgccgatatcggaacttatccccgactgtgcgtgtaacatggcgcgtttttgccagccatatttcacgggggtattggcgacaaactccgccagttgcgcgctaatgcgataacccacttcatttgcggcggcctctttaccgtagcgtgcggcaatcccttctttttcacacagcaagttaaccgcttccgccagcccatacatgccaaacatcggcacaaaacgttcagggttaatcagcccttctttcaccaggaagctattctcaaagaagtgtgattgttgatagaggaattcacaccgcgcatcgatgatggcgatctgctgttggcagtagtgcggtagagtgcgcgtaaagaagtcctccagcgattcactgcgctcggcaatggctttcaggtttaggcgtaccagcgtgctgccaccacccgccagcggcagtgagttgtaacagctcacaatcccgtagcccccttttgtgaaaattttatcatgcaccggaccgttggcgatgtgcggtttgctacattcacagatgtttttcgccacttccagcagcaggtcatcaggggtgatatcaggatcgtagataaaggtcaggttcggtgaaacctgcttcagctctgcgtctgcacgtaatatcgcacgggtaatgggcgaatcagacgggccgatattggcatgcataaaggcgtctgacagggttctgtcgaggtaacgccagaaacgttttattcgaatatcgatctcgtcttgtgttagaattctaacatacggttgcaacaacgcatccagttgccccaggtagaccggcatcgatgtgaccgaaggaacgtggtggtaaagaatggtcagcagagagagtgcgtcatcaagatcttttgcgccttccagctccagccattcggaaccgttggccaaaaaacgggcgtaatcgggtaagacatagcgcggtttgtacggcgcatgaccttcaaacatatcgcagattaccccctcatccagcgcgcggcgggcttcggcaggcagctgtgggtaaggcagattattttctgcttccagtgccagaaaatggcgcttctgctccgggctaagtaccgggctggtgacaatttgctggcaacgttgttgcagtgcattttcatgagaagtgggcatcttcttttccttttatgccgaaggtgatgcgccattgtaagaagtttcgtgatgttcactttgatcctgatacgtttgccaccactgacgcattcatttgaaagtgaattatttgaaccagatcgcattacagtgatgcaaacttgtaagtagatttccttaattgtgatgtacatcgaagtgtgttgcggagtagatgttagaatactaacaaactcgcaaggtgaattttattggcgacaagccaggagaatgaaatgactgatctgaaagcaagcagcctgcgtgcactgaaattgatggacctgaccaccctgaatgacgacgacaccgacgagaaagtgatcgccctgtgtcatcaggccaaaactccggtcggcaataccgccgctatctgtatctatcctcgctttatcccaattgctcgcaaaacgctgaaagagcagggcaccccggaaatccgtatcgctacggtaactaacttcccacacggtaacgatgacatcgaaatcgcgctggcagaaacccgtgcggcaatcgcctacggtgccgatgaagttgacgtagtgttcccgtaccgtgcgctgatggcaggtaacgagcaggttggttttgacctggtgaaagcctgtaaagaggcttgcgctgcggcgaacgtactgctgaaagtgattattgaaaccggcgaactgaaagacgaagcgctgatccgtaaagcgtctgaaatctccatcaaagcgggtgctgacttcatcaaaacctctaccggtaaagtggctgtgaatgcgacgccggaaagcgcgcgcatcatgatggaagtgatccgcgatatgggcgtagaaaaaaccgttggtttcaaaccggcgggcggcgtgcgtactgcggaagatgcgcagaaatatctcgccattgcagatgaactgttcggtgctgactgggctgatgcgcgtcactaccgctttggtgcttccagcttgctggcaagcctgctgaaagctctgggccacggcgacggtaagagcgccagcagctactaaggcttgatttgccggatgatgcagcgatgctcatccggttccccgattacctcgtctcttttccacgggaggttaccttgtttctcgcacaagaaattattcgtaaaaaacgtgatggtcatgcgctgagtgatgatgaaattcgtttctttatcaatggcattcgcgacaacactatctccgaagggcagattgccgccctcgcgatgaccattttcttccacgatatgacaatgcctgagcgtgtctcgctgaccatggcgatgcgagattcaggaaccgttctcgactggaaaagcctgcatctgaatggcccgattgttgataaacactcgaccggcggtgtcggcgatgtgacttcgctgatgttggggccgatggtcgctgcctgtggcggctatattccgatgatctccggtcgcggcctcggtcatactggcggtacgctcgacaaactggaatccatccctggcttcgacattttcccggatgacaaccgtttccgcgaaattattaaagacgtcggcgtggcgattatcggccagaccagctcattggctccggcggataaacgtttctacgcgacccgcgatattaccgcaaccgtggattcaatcccgctgatcaccgcctctattctggcgaagaaactggcggaaggtctggacgcgctggtgatggacgtgaaagtgggtagcggcgcgtttatgccgacctacgaactctctgaagcccttgccgaagcgattgttggcgtggctaacggcgctcgcgtgcgcaccaccgcgctgctcaccgatatgaatcaggtactggcctccagtgcaggtaacgcggttgaagttcgtgaagcggtgcagttcctgacgggtgaatatcgtaacccgcgtctgtttgatgtcacgatggcactgtgcgtggagatgctgatctccggcaaactggcgaaagatgacgccgaagcgcgcgcgaaattacaggcggtgctggacaacggtaaagcggcagaagtctttggtcgtatggtagcggcacaaaaaggcccgaccgacttcgttgagaactacgcgaagtatctgccgacagcgatgctgacgaaagcagtctatgctgataccgaagggtttgtcagtgaaatggatacccgcgcgctggggatggcagtggttgcaatgggcggcggacgccgtcaggcatctgacaccatcgattacagcgtcggctttactgatatggcgcgtctgggcgaccaggtagacggtcagcgtccgctggcagttatccacgcgaaagacgaaaacagctggcaggaagcggcgaaagcggtgaaagcggcaattaaacttgccgataaagcaccggaaagcacaccaactgtctatcgccgtatcagcgaataacggtatactgatctgatcatttaaatttgaagcactgagtacggagaacatatgaaacgtgcatttattatggtgctggactcattcggcatcggcgctacagaagatgcagaacgctttggtgacgtcggggctgacaccctgggtcatatcgcagaagcttgtgccaaaggcgaagctgataacggtcgtaaaggcccgctcaatctgccaaatctgacccgtctggggctggcgaaagcacacgaaggttctaccggtttcattccggcgggaatggacggcaacgctgaagttatcggcgcgtacgcatgggcgcacgaaatgtcatccggtaaagataccccgtctggtcactgggaaatcgccggtgtcccggttctgtttgagtggggatacttctccgatcacgaaaacagcttcccgcaagagctgctggataaactggttgaacgcgctaatctgccgggttacctcggtaactgccactcttccggtacggtcattctggatcagctgggcgaagagcacatgaaaaccggcaagccgattttctatacctccgctgactccgtgttccagattgcctgccatgaagaaactttcggtctggacaaactctacgaactgtgcgaaatcgctcgtgaagagctgaccaacggcggctacaacatcggtcgtgttatcgctcgtccgtttatcggcgacaaagctggtaacttccagcgtactggtaaccgtcacgacctggctgttgagccgccagcaccgaccgtgctgcagaaactggttgatgaaaaacacggccaggtggtttcggtcggtaaaattgcagacatctacgccaactgcggtatcaccaaaaaagtgaaagcgaccggcctggacgcgctgtttgacgccaccatcaaagagatgaaagaagcgggtgataacaccatcgtcttcaccaacttcgttgacttcgactcttcctggggccaccgtcgcgacgtcgccggttatgctgcgggtctggaactgttcgaccgccgtctgccggagctgatgtctttgctgcgcgatgacgatattctgattctcactgctgaccacggttgtgacccgacctggaccggtactgaccacacgcgtgaacacattccggtactggtttacggcccgaaagtgaaaccaggttcgctgggtcatcgtgaaaccttcgcggatatcggccagactctggcaaaatattttggtacttctgatatggaatatggcaaagccatgttctgatggatttgggcggagcagtgactccgcctttaatatgtcacaaaaaggataaaatgatggctactccacacattaatgcagaaatgggcgattttgctgacgtagttttgatgccaggtgacccgctgcgtgcgaagtatattgctgaaactttccttgaagatgcccgtgaagtgaacaacgttcgcggtatgctgggcttcactggtacttacaaaggccgcaaaatttccgtaatgggccacggtatgggtatcccgtcctgctccatctacaccaaagaactgatcactgatttcggcgtgaagaaaattatccgcgttggttcctgtggcgctgttctgccgcacgtaaaactgcgcgacgtcgttatcggtatgggtgcctgcaccgattccaaagttaaccgcatccgttttaaagaccatgactttgccgctatcgctgacttcgacatggtgcgtaacgcggtagacgcggcaaaagcactgggcgttgatgctcgtgttggtaacctgttctccgctgacctgttctactctccggacggcgaaatgttcgacgtgatggaaaaatacggcatcctcggcgtggaaatggaagcggctggtatctacggcgtcgctgcagaatttggcgcgaaagccctgaccatctgcaccgtgtctgaccacatccgcactcacgagcagaccactgccgctgagcgtcagaccaccttcaacgacatgatcaaaatcgcgctggaatccgttctgctgggcgataaagagtaattgtgttttgctgaaaggcgattgtcgtgtgaagccggagtgggagactgctccggctttttattatctattcatttctctctccagcttgaatattttcgctatacttttcagtgaaatgtgttaataaatctattcaagtatctattcacgaatctattcattaatgagcgaattgaccgatcttttattgcaagggccgcgttctgccccggaattgcgccagcgtctggcaatcagtcaggcgacgttctcacgccttgttgccagagaagatcgggtgattcgctttggtaaagcacgggcaacgcgatatgcactgctgcgtccttatcgcggaattgagcgtattcccgtatggcgagtggatgatgccggaaaggcgcataaattcgccgacatccggttgtgctggccgcagggaagttgtctggtaacaggcgcagatggcgacgaacggtggtttgatggtttgccctggtatttgaccgatctgcgactgcaggggtttttggggcgcgcgtggggcaggaagttagccgcgcaactgaatcttactgaagatatccgtctctggcaggaagaagatgtgctctacgccctgaccgtatttagcggtgaatacaccggcggctggctggtcggggaggggaattatcagcgatggattactgcacaacgccctgcggcaattcctctggatcaaaaactcacccattacgaacaactggcaagcgatgcactggcaggagaaattgtgggttcttctgcgggcggtgagcagccaaaatttacctgctatgcacaaacgccgtcaggcaataaacatgtgctggttaaattcaccgtgccacagcaaaccgcggtcagccaacgttggggcgacttgcttattgcggaatctattgccgcgcaaatcctgcgcgacggcgggatccacgccatcgagtcaacggtgcttgtaacaagtaacaggcaggtattccttgaagcggaacgatttgactgcaaaggtaacgatggtcgcttgcccattgtgtcgctggaggcggtgcagagtgagtttatctcttctccgggatcgtggccggaggctatgcgccgtttgtgtgagcaacaacttgtcactcaccagagcgtggcgcaaacagaagtgatctgggcgtttgggcgacttatcgccaacagcgatatgcacgcaggcaatttatcattttatttatctgaaccaccatttgcgctgacgcccgtctacgacatgctgccgatggcctatgcaccaaacagcgccggaatgttgcgtgatgctgccattgaggtgaggtttgatcttaacgtcagtaaaagtgcatggttaacggcgatcccgctggcgcagcagttctggcaaacggtcgccggagatccgcgtatcagcgaggcatttcgccacattgcacaagaaatgccggaaaaaatccggcaaatcgaagggaaagttgcccgcatgggcgggtaactatcgcaccgcccccgctatccatgccgacaactcccgtagctctttttcctgttccgggaagtcaaccagcagcgcttcgcactcctgttgcagcatatccgcgcggtacagacagccttgcagtcgcccggcgagggcttccagcggcgcggggttgagactgtcggtaaacacctgggcgcgggtgatatggcctttttcaacgtcgaaatgcagttccacgccgccccaggtaaagcgttcatccagcagatgcgagaattccggagcctgaccgaagttccattcccagctactctggcgggcaaaggtttcggcgaagtttggcaagtctggcgttttgtccggggagatgatttccgcttccacgcgctcgccataatgggcgaaaaaggcctcggttatggcctcgcaaacctgctcatgggtgatccccggtagcaattcggtcagattggtcacgcgggaacgcactgaggtaatgcctttcgccgccagtttctttttatccggattgagatagtttgccaggcggctaaggtcggaattgagcagcaaagtgccgtggtggaagccacgatctttggtttcgcgataggccgagcctgagactttgcgatcgccttcggcggttttcaccaccagatcgttacgcccggaagcttcggcgctgacgccgagcgcgttcagcgcattgagtacaatcgacgtggagatggttttatcgtactccggcttgccagccataaaggtaaaacaggtattgccgagatcgtggaacactgcgccgccaccgctactgcgccgcgccaggcggacgttatcttcttccatccgccgggtattacactctttccacgggttctgcgcgcgaccaatcactaccgtgtcggcattgcgccagagaaacagaacgcgctgcgtagccggcatctggcgaaaaatacactcctctaccgccaggttaaaccacgggtcgtaagagtcagagatgagcaggcgtaatgtggacataacgatttcctttcttgtagtaatgggtcactcttttttctcgctttcttcctcttccggcaccggtttactggcggttaacaggaagggcgattgctgccagcgggtgcgtttaccctgtagcagcgtgcgggtcagcactacgccgattgccagcgagagcagcaacatcaggcgtaaaatgttagtggtgttatccacctgttgggcttcggtggcgagcgtatgggtgtcgagcgtcaggcgcagatagccgagcggtccgtttttacccgcaatgggttcgacaatctgctggttaaaatagccgcccgcttttttgccgtcgagcgccagccggtcgcgcacgtcgacgctttcgccagaacgggcgataagatcgccttgctcatcatatacgcctgcgtcgagaatgcggctttcatccgttaactgatcgaggatcgcctgaatgcgtttttcatccggtgagtcggtacgcatcagcggtgcaacgtttagcgtcacctgccgcgccagggtgcgggccagttcttccagttgcggattacgctgtcgctggtggttttgactaaaccatgacgccccctgcatcagcgccactaacaaggcaagacagaacaggacaatcactgcccgatgcagccggaatttcagttttgtgcgagccatcttccaccctttgaaaatttgagacttaatgttgccagaagcaatggatacaaggtagcctcatgcgttattttccctgcttcgaacgattttacaggagccttaatgcctaacattacctggtgcgacctgcctgaagatgtctctttatggcctggtctgcctctttcattaagtggtgatgaagtgatgccactggattaccacgcaggtcgtagcggctggctgctgtatggtcgtgggctggataaacaacgtctgacccaataccagagcaaactgggcgcggctatggtgattgttgccgcctggtgcgtggaagattatcaggtgattcgtctggcaggttcactcactgcgcgggctacgcgcctggcccatgaagcgcaactggatgtcgcgccgctggggaaaatcccacacctgcgcacgccggggttgctggtgatggacatggattccaccgccatccagattgaatgtattgatgaaattgccaaactggccggaacgggcgagagggtggcggaggtaaccgaacgggcgatgcgcggcgaactcgattttaccgccagcctgcgcagccgcgtggcgacgctgaaaggcgctgacgccaatattctgcaacaggtgcgtgaaaatctgccgctgatgccaggcttaacgcagctggtactcaagctggaaacgctgggctggaaagtggcgattgcctccggcggctttactttctttgctgaatacctgcgcgacaagctgcgcctgacagccgtggtagccaatgaactggagatcatggacggtaaatttaccggcaatgtgatcggcgacatcgttgacgcgcaatataaagcgaaaaccctgacccgcctcgcgcaggagtatgaaatcccgctggcgcagaccgtggcgattggcgatggagccaatgacctgccgatgatcaaagcggcagggctggggattgcctaccatgccaagccaaaagtgaatgaaaagacggaagtcaccatccgtcacgctgacctgatgggggtattctgcatcctctctggcagcctgaatcagaagtaattgtccgcccgtcatcctgcgggcggcacagcattaacgaggtacatcgtggcaaaagctccaaaacgcgcctttgtttgtaatgaatgcggggccgattatccgcgctggcaggggcagtgcagtgcctgtcatgcctggaacaccatcaccgaggtgcgtcttgcagcgtcgccaacggtggcgcgtaacgagcgtctcagcggctatgccggtagcgccggagtggcaaaagtccagaaactttccgacatcagccttgaagagctgccgcgtttttccaccggatttaaagagttcgaccgcgtattaggcggcggcgtggtgccgggaagcgccattctgattggcggtaaccctggtgcggggaaatccacgctgttgctgcaaacgctgtgcaaactggcgcagcagatgaaaacgctgtatgtcaccggcgaagagtcgctgcaacaggtggcaatgcgcgctcatcgccttggcctgccgactaacaatcttaatatgctgtcggaaaccagcatcgagcagatctgcctgattgccgaagaagagcaaccgaagctgatggtaattgactccatccaggtgatgcatatggcggatgtacaatcatcgcctggcagcgtggcacaggtgcgtgaaacggcggcttatctgacgcgcttcgccaaaacgcgcggtgtggcgattgtcatggtcgggcacgtaaccaaagatggctcgctggctggccctaaagtgctggaacactgtatcgactgttcggtgcttttggatggtgatgccgactcacgttttcgcaccttacgcagccataaaaaccgcttcggcgcggtgaatgagctgggtgtcttcgcaatgaccgagcaggggctgcgtgaagtcagcaacccttcggcaattttcttaagtcgcggcgatgaagtgacctccggtagctcagtgatggtagtgtgggaaggaacgcgtccgctgctggtggagattcaggcgctcgtcgatcactcgatgatggcgaatccacgccgcgtggcagtcgggctggagcaaaaccgtctggcaatcctgctggcggtgcttcaccgtcacggtggtctacaaatggccgatcaggatgtgtttgttaacgtggtcggtggcgtgaaggtgacggaaaccagtgccgatttagcgttactgctggcgatggtttccagcctgcgtgacagaccgctaccgcaggatctggtggtgtttggtgaagtcgggctggcaggggagatccgcccggtgcccagcggccaggaacgaatctcagaagcggcgaaacacggttttcgccgggcaattgttccggcagctaacgtgccgaaaaaagcgccggaagggatgcagatttttggcgttaaaaaactctccgacgcgcttagcgtgttcgacgacttataatgagagatacggagggagatatgtcgtcatttgattacctgaaaactgccatcaagcaacagggctgcacgctacagcaggtagctgatgccagcggtatgaccaaagggtatttaagccagttactgaatgccaaaattaaaagccccagcgcacaaaagctggaggcattgcaccgttatttgggacttgaatttccccggcagaagaaaacgagcggtgtcgtattcggtaagttttacccgctgcatactggacatatctaccttatccagcgcgcctgtagccaggttgacgagctgcatatcattatgggttttgacgatacccgcgaccgcgcattgttcgaagacagcgccatgtcgcagcagccaaccgtgccggatcgtctgcgctggttattgcagacctttaagtatcaaaaaaatatccgcattcatgcttttaacgaagagggcatggaaccgtatccacatggctgggatgtgtggagcaacggcatcaaaaagtttatggccgaaaaaggcattcagccggacctgatctacacctcggaagaagccgatgcgccgcagtatatggaacatctggggatcgagacggtgctggtcgatccgaagcgtacctttatgagtatcagcggtgcgcagatccgcgaaaacccgttccgctactgggaatatattcctacggaagtgaagccattctttgtgcgtaccgtggcgatcctcggtggtgaatcgagcggtaaatccaccctggtaaacaaacttgccaatatcttcaacactaccagtgcgtgggaatatggtcgtgattatgtcttttcgcacctcggtggcgatgagatcgcgttgcagtattccgactacgataaaatcgctctgggacatgcgcaatatattgattttgcagtgaaatatgccaataaagtggcgtttatcgacaccgattttgtcactacccaggcgttctgcaaaaagtacgaagggcgtgagcatccgttcgtgcaggcgttgattgatgaataccgtttcgatctggtgatcctgctggagaacaacacgccgtgggtggcggatggtttacgcagcctcggcagttcggtggatcgcaaagagttccagaacttgctggtggagatgctggaagagaacaatatcgaattcgtgcgggttgaagaggacgattacgacagccgtttcctgcgctgcgtggagctggtgcgggagatgatgggggagcaaagataatcatctttataagatgttgagtgggattactgatttaaaagtgtacttagtactccatttcggtgtacaatgtaccccccagggaggggtaatgggtaaggcgataatatttatagagacgccaatatttacgcgtcagatcaagcagattgcaaccgatgatgaattaaaggaattacaaaaagaactcatcggaactcccgataaaggtgatctcattcagcagactggtggattgcgtaaagtccgaatggctgcgggttcacagggaaaaagtggcagtgtcagaataatttactttctggcgacggaagagattatttatttgattatggcctatccgaaaaatgccaaagatagtctgacagatacggaaaaagctcaactaaagaagttgacgaaactgctcaaaggcgagatataaaatgagtttttttgatgagttgaaaacctctctggaagaggctgtcgagattaaacaaggtttaaaagaacctgcacgggtgacccgctacgaaattgcggatgttaaagctattcgtgagcaactcaacgtttctcaaagtgagatggcaaaagctctgggaaccagtgtggataccattaaaagctgggaatcgaagcgaagaaatcctacgggattggctgcaaaagtacttgccacaattaaagaaaatcctgcctttttccgggaacttgcttcccattaatcatttaactaataccggatgcgatgctggtgcgccgcatccggcattttacgcattacttcgcaatacgcttgtacttgatacgcttcggctccagcgcgtctgcgcccagcgtgcgtttcttgtactcttcgtactcggtaaagttaccttcgaagaactcaactttaccttcatcctggtaatccagaatgtgggtggcgatacggtcgaggaaccaacggtcgtgcgagataaccatcgcgcagcccgggaactccagcagggcgttttccagtgcgcgcagggtttcgatatccaggtcgttggttggttcgtcgagcagcagcatgttgccgccaacctgcagcagcttcgccagatgcagacgaccgcgctcaccgccggagagttcgccaacgcgtttaccctgatcaacccctttaaagttaaagcggccaacgtaggcgcggcttggcatctcggtgttgccgatcttcatgatatccagcccgccggaaacttcttcccaaacggttttgctgttatccattgagtcacggaactgatcaaccgacgccagtttcaccgtttcacccaaagtgatggtgccgctgtccggctgttcctgaccagagatcatacggaacagcgtcgatttacccgcaccgttcggaccgatgatcccgacgatcgctcctttcgggatcgagaagctcagggagtcaatcagcagacgatcaccataggatttacgcaggttgctgacttccagcactttatcgcccagacgcggtccaggtggaataaacagttcgttggtttcgttacgtttctgatattcggtgctgttgagttcttcaaagcgcgccagacgtgctttaccttttgactgacggcctttagttccctgacgtacccactccagctctttctcgatcgacttacgacgcgccgcttcttgtgaagcttcctgcgccagacgctgatctttctgctccagccaggaggagtagttaccttcccacggaataccttcaccgcggtcaagttcgaggatccagcccgcaacgttatcgaggaagtaacggtcgtgggtaatcgccaccacggtgccttcgaagtcgtgcaggaagcgttccagccacgctacggattccgcatccaggtggttggtcggttcgtcgagcagcagcatgtctggtttttccagcagcaggcggcacaacgccacgcgacgacgctcaccaccggaaaggttagctattttcgcgtcccagtccggcagacgcagcgcatccgccgcacgctccagctgaacgttcaggttgtgaccgtcgtgagcctgaatgatctcttccagacggccttgttcagcggccagcttgtcaaaatcggcatccggatcggcatacagcgcatacacttcatccaggcgtttcagggcgttaaccacttcagaaaccgcttcttcaatggactcacgaacggtgtgttccgggttcagctgcggttcctgcggcagataaccaatcttgatgtctggctgcggacgcgcttcaccttcgatgtctttatcaatgcccgccataatgcgcagcagggtggacttacccgcgccgttcagacccaggacaccaatttttgccccagggaagaaactcagagagatgtttttcaaaatatgacgtttcggcggaacaactttgccgacacgatgcatggtataaacgaattgagccacgttggacttcgcctctatgtttatcgtgatgatgagttttcaaaggcgaagtgtagcctgtttccctgtctaatcccagccagtcgatcaccccgtaaaagtaaaaaagtgtccgtaacgtggcgtaaacggcaatgactggttagcataaatctattacgcggcatgacgctgcattgatgtatttacacttagaggatgcgcttgtggaaaaagccaaacacgttacctggcggctgttggctgtcggtgtctgtctgctgacggtcagcagcgtagcgcgagccgactcactggacgagcagcgtagccgttacgcgcaaattaagcaggcctgggataatcgacaaatggatgtggtcgaacaaatgatgcctggactgaaagattacccactttatccctacctggaataccgccagatcactgatgacctgatgaatcaaccggcggtgacggtcactaactttgttcgcgctaaccccacgcttcctcccgctcgcacgctgcaatctcgtttcgtcaatgaactggcgcggcgtgaagactggcgtggcttgttagcctttagcccggaaaagcccggaactaccgaagcgcaatgtaattactactatgcgaaatggaacaccgggcagagtgaagaagcctggcaaggggcgaaagagctgtggctaaccggcaagagccagcctaacgcctgtgacaagttatttagcgtctggcgtgcgtcaggtaaacaagatccgctggcgtatttagagcgtatccgtctggcgatgaaagcgggtaacaccggcctggtaacagtgctggcagggcagatgcctgccgattaccagactatcgcttcggcaatcatttcactggcgaacaaccctaatacggtactgaccttcgcgcgtacaactggcgcgaccgattttacccgtcaaatggcggcggtggcgtttgccagtgtggcgcggcaggatgctgaaaatgcacggctgatgatcccgtcgcttgctcaggcacagcagcttaatgaagatcagattcaggagctgcgcgatattgtcgcctggcgtttgatgggcaacgatgtcaccgacgagcaggcgaaatggcgcgatgacgcgattatgcgctcgcaatctacttcgcttattgaacgccgtgtgcgaatggcgcttggcaccggcgatcgtcgcggcctgaatacctggctggcgcgtctgcctatggaagcgaaagagaaagatgaatggcgttactggcaggcggatttattgctggaacgcggacgtgaagctgaagcaaaagagattttgcatcaactcatgcaacagcgtggtttctacccgatggttgctgcacaacgcatcggcgaagagtatgagctgaagattgataaagcgccgcagaatgttgacagcgccctgactcaggggctggagatggcgcgcgtgcgcgagttgatgtactggaatctcgataacaccgcgcgtagcgagtgggccaatctggtgaagagcaagtcaaaaacagagcaggctcaactggctcggtatgctttcaataaccaatggtgggatcttagcgttcaggcaacgatcgccgggaagctttgggatcatctggaagagcgattcccgctggcttacaacgatcttttcaaacgctacaccagtggtaaggagatcccgcaaagctatgcgatggcgattgcccgtcaggagagtgcctggaatccaaaagtgaaatcaccggtaggggccagcggcctgatgcaaattatgcctggtaccgcgacccatacggtgaagatgttctctattcccggttatagcagccctgggcaattgctggatccggaaacaaacatcaacattggcaccagttacctgcaatatgtttatcagcagtttggcaataaccgtattttctcctcagcagcttataacgccggaccagggcgggtgcgaacctggcttggcaacagcgcaggacgtatcgacgcagtggcatttgtcgagagtattccattctccgagacgcgcggttatgtgaaaaacgtgctggcttatgacgcttactaccgctatttcatgggggataaaccgacgttgatgagcgccacggaatggggacgtcgttactgatccacacgtttatgatatgctatcgtactctttagcgagtacaaccgggggaggcattttgcttcccccgctaacaatggcgacatactatggcccaacaatcaccctattcagcagcgatggcagaacagcgtcaccaggagtggttacgttttgtcgacctgcttaagaatgcctaccaaaacgatctccatttaccgttgttaaacctgatgctgacgccagatgagcgcgaagcgttggggactcgcgtgcgtattgtcgaagagctgttgcgcggcgaaatgagccagcgtgagttaaaaaatgaacttggcgcgggcatcgcgacgattacgcgtggatctaatagtctgaaagccgcgcccgtcgagctgcgccagtggctggaagacgtgttgctgaaaagcgattgattttgtaggcctgataagacatggcgcatcaggcatcgtgcaccgaatgccggatgcggcgtgaacgcctaatcaggcctgcaatggctgatacacggcattatgaaacggactcagcgccaggatcaccgcctggtgatagacgctggtgcgagtgagtttcccggcggtaaacacgccgatcgccccttccttacgaccaatctcatcaataccggtataacgcgacatcacgggaccaagcgcctcaccttcacgcactttttccagaatcaccgcaggcaacggcaaagtagccgaacgcgcctcgccgcgctggctggcgttttcaatcaccacccaactgaaagtgctgtcaccatcgatgccagcttcaatcgccacccaaaaatcagcctcaggaagtaaacggcgggcattggctaccctatttcgtgcgccagcgcgcgtttcctcactgccaaagggctgttccggtacaccgctctcgacggcaacggatgcaatatggcaggatccttcgccgaagatctcgtgaaatgcctgcagagtggcctgaattttagcgggattggtggtcgcacagacaacttggtgcataatcagcattactcagaaaattaacgttacagcagtatacggaaaaaaagcatgttacaggtatacctagtccgccacggtgaaacgcagtggaacgccgagcgacgtattcagggccagtctgacagcccgctgaccgccaaaggtgagcaacaggcgatgcaggtggcaacccgtgccaaagagcttggcattacgcatatcatcagtagcgatttaggacggacccggcgcacggcggaaatcatcgcccaggcctgcggctgtgacatcatctttgattctcgcctgcgtgaattaaatatgggtgtactggaaacaagaaatatcgattcactcaccgaagaagaagagaactggcgtcggcagctggtcaatggcaccgttgacgggcgtattcctgaaggcgagtcaatgcaggagctcagcgatcgcgttaatgcggcactggaatcttgccgggacttaccgcagggaagccgaccgctactggtgagccatggtattgcactgggatgcctggtgagtacgattctcggattaccagcatgggcagagcgccgcttacgtctgcgtaactgttctatttcgcgcgtggattatcaggaaagcttgtggctggcgtctggctgggtggttgaaaccgcaggggacatctcgcatctggacgcccctgcattagatgagctgcagcgttaacgacggatcggaatcagcagttcacagcgcagattaattgggcgatctcccgctttggcatcttctgccgggtagtatcgctcaatatcctgacctttacggcgcgtcaggttaagcattggcatgcacgttccgtataccgtcaggataaactcctgcacgccggttcccagaccttcataggtaaacatcacatattcgccgccctgcaacatcaccggatgcccagtcagtacatagccatctgcctgatcctgagctaacgcggtggtgtagaacacctcttgttcgtcgtctttatcctggctcggacgtgtttcgttcaaaccgtaaagcactggtggaatggttggcgagttgccgagaaaatcgtgccagaactggtagcgcatttcatggcggaaatcagagatttgctccagcgaacaggagtagctctgggtaacaccaatcagcggcgtatcttccagagtgacaaatttgtgctctggcatagtgaattcacccagacgtagcggcgggcgaataccaaaggcgctccattcaggagaacggcggtaaagtgcaggagtctgggcaaactgcttcttgaaagcgcgggtaaatgtctgttgagagtcgaagcggtattgcagcgcgatgtccagaatcggacgcgcagtcaggcgtagtgcgaccgccgatttcgacaaacgacgagcacgaatatacgcgccaatagcatggccagtgacatctttaaacattctctgtaagtgccacttggaataacctgctttcgccgctacattgtcgagcgacaggggatgatccagatgaccttccagccagattaaaaggtcgcgaataatgccggcctgatccataaaatatcctcatcctttcaacaacgagcacctgacatcaggtaattggataatagcattttttgctgttttagcattcagtgtttttttcttagtcgagtatgttttaggtcttgacggaaataaaagtattgagattttgttcttaatcaatatgttatttaccgtgacgaactaattgctcgtgtaatagataaaaatggtaacgatatgaaatacaagcatttaatcctgtctttaagcctgataatgctggggccattggctcatgcagaagagattggttcggtcgacaccgtatttaaaatgatcggcccggatcacaaaattgttgttgaagcctttgacgatcccgatgtgaaaaatgtcacctgttatgtgagccgggcgaaaaccggtggtattaaagggggattgggcctggcagaagatacctccgatgcggccatttcttgtcaacaagtcgggccgattgaactgtcggatcgtattaaaaacggcaaagctcagggcgaggtagtattcaaaaaacgcacgtccctggtctttaagtcgttacaggtcgtgcgcttttatgacgctaaacgcaacgcgctcgcttatctggcttactccgacaaagttgtagaaggttcgccgaaaaacgcgattagcgcggttcctgtcatgccgtggcggcaataacagaggcgatttatgcaacgggaaacggtctggttagtcgaagacgagcaagggatagccgatacgctggtctacatgttgcaacaggaaggttttgacgtcgaggtctttgagcgaggcttgccagtgctggataaagctcgccagcaggttcccgatgtcatgattctcgatgttggtttgcctgatatcagcggctttgaattgtgccgccagttactggcgctccatccggcgttacctgtactgttcctgacggcccgaagtgaagaggtcgatcgcctgcttgggctggaaattggcgctgacgactacgtggctaaaccgttttcacctcgcgaagtgtgcgccagagtgcgcaccttactgcgtcgggtgaagaagttctcgacgccgtctcccgttatccgtattggtcattttgaattgaatgaacctgcggcgcagatcagctggtttgacacgccattaacgctgacgcggtatgagtttttattgctgaagacgttactcaagtcgccgggccgcgtctggtcccgccagcaactgatggatagcgtgtgggaagatgcgcaggacacctacgatcgcaccgtcgatacccacattaaaacgctgcgtgccaagctgcgcgccatcaaccccgatctttcaccgattaatactcatcgcggcatgggatatagcctgaggggcctgtaatgcgtatcggcatgcggttgttgctgggctattttttactggtggcggtggcggcctggttcgttctggctatttttgtcaaagaagttaaaccgggcgtgcgaagagcaaccgaggggacgttaatcgacaccgcaacgttgctggcggagctggcgcgtcccgatttgctctctggggacccaacgcatgggcaactggcgcaggcgtttaatcagctacaacatcgcccgtttcgcgccaatatcggtggcattaacaaagtgcgcaacgaatatcatgtctatatgaccgatgcgcagggcaaagtattgttcgattcggcaaataaagccgttggacaggattattcgcgctggaatgacgtctggctaacgttgcgtggtcagtatggtgcgcgcagcacgttgcaaaatcctgccgatcccgaaagttctgtgatgtatgttgccgcgccgattatggacggctcgcggcttattggcgttttgagcgtaggcaaaccgaacgcggcgatggctccggtcattaagcgtagcgagcggcgaattttatgggccagcgccattttgttggggattgcactggtgattggcgcaggcatggtttggtggatcaaccgctctattgcccggctcactcgctatgctgattccgtcactgacaataagcccgttcctctccccgatctcggtagtagcgagttgcgtaaactcgcgcaggcgctggaaagtatgcgcgtgaagctggaagggaaaaactatattgagcagtatgtttatgcgttaactcatgagctaaaaagcccactggcggcgattcgtggcgcggcggaaattttacgcgaaggtccgccgccggaagtggtggctcgttttaccgacaacattctgacgcaaaatgcgcgaatgcaggcactggtggaaacgttactacgccaggcaagactggagaatcgtcaggaagtcgttctgactgctgttgatgtggcggcattatttcgccgcgtcagcgaagcgcgcaccgtgcagttggcagaaaaaaacatcactttgcatgttatgcctactgagattaacgttgctgctgaaccggcgttactggagcaggcgctggggaatttactggataacgccatcgattttactcccgagagcggttgcataacgctaagcgccgaagtggatcaggaatacgtcacccttaaggtgctggataccggtagtgggattcctgactacgcgctgtcacgtatttttgaacgcttttactctttgccgcgtgcaaatgggcaaaaaagcagcggtctggggttggcgtttgtcagtgaggtcgcccgtttgtttaacggcgaagtcacgctgcgcaacgtgcaggaaggtggcatgctggcctcgcttcgacttcaccgtcacttcacatagcttcaaattcttcccacatagccttcgtatcctgctgtcattgcaaaggagaagactatgttgaaatcccccctgttctggaaaatgaccaccttgtttggtgcagtattgctgttgttgattccgataatgctgattcggcaggtgattgtcgaacgtgccgattaccgtagcgatgtggaagatgtgattcgccaaagtaccagcgggccgcaaaaactcgttgggccgctcatcgctattcctgtgaccgagctttatacggtgcaggaagacgataaaaccgtggagcggaaaagaagttttattcatttttggttacctgagtcattgatggttgatggcaatcagaacgtggaagaacgcaagataggcatctataccggtcaggtctggcacagtgatttaacgttaaaagccgatttcgatgtttcgcgtcttagcgaactcgacgcgccaaatatcaccttaggcaagccatttattgtgattagcgtcggggatgcgcgtggtattggtgtggtgaaagcgcctgaagttaacggtacggcgctgaccattgaacccggcaccgggttagagcaaggcgggcagggcgtgcatatccctttacccgaaggggactggcgcaagcagaacctgaagctgaatgtggcgctgaatttaagcggtaccggcgatctttctgtggtgcctggcgggcgttatagcgaaatgaccttaaccagcaactggccgcatcccagttttttaggtgattttctaccagccaaacgggaagttagcgagtcaggttttcaggcgcaatggcaaagtagctggtttgctaataatctcggtgagcgttttgcttcaggcaatgataccggctgggaaaacttccccgcgtttagcgtcgcagtgacgacgccagccgatcaataccaattaacggaccgggcgactaagtacgccattctgctgattgcgctgacttttatggcattctttgtttttgaaacgctcaccgcgcaacgtttacacccaatgcaatatttgctggtggggctgtcattggtgatgttttatttgctcttgctggcgctttctgaacataccggttttactgtggcatggataatcgccagtctgattggggcgttaatgaacggtatttatttgcaggcggtattgaaaggctggcgtaatagcatgttgtttaccctcgcgctgttgttgctggatggtgtgatgtggggactgctcaactctgccgatagcgcgctgttgttgggaacctgtgtgctggtggtggcgctggccggcatgatgtttgtgacccgtaatatcgactggtatgcgttttcactgccgaaaatgaaagccagtaaagaagttaccatggacgatgaattacgtatctggaaataaggtagaaaaataaaaacggcgctaaaaagcgccgtttttattgacggtggtaaagccgattaatcttccagatcaccgcagaagcgataaccttcaccgtgaatggtggcgatgatttccggcgtatccggcgtagattcgaaatgtttacgaatacggcggatcgtcacgtctacagtacggtcgtgcggtttcagctcacggccggtcattttcttcagcagttcagcacgggactgaattttgcctgggttttcacagaagtgaagcatggcgcggaactcgctgcgcggcagcttgtactgctcgccatcagggccgatcaacgaacggctgttgatgtccagttcccaaccattgaacttgtagctttcaacgctacgacgttcttcgctgacagtacccagattcatggtacgggacagcaggttgcgtgcacgaatagtcagttcacgcgggttgaacggtttggtgatgtagtcatctgcaccgatttcgaggccgagaattttatcgacttcgttgtcacggccagtcaggaacatcaacgcaacattcgcctgctcgcgcagttcacgcgctaacagaagaccgtttttacccggcagattgatatccatgatcaccaggttgatgtcatattcagagaggatctgatgcatttccgcgccatctgtcgcttcgaaaacatcatagccttccgcttcgaaaatacttttcaacgtgttgcgtgttaccaactcgtcttcaacgataagaatgtgcggggtctgcatgtttgctacctaaattgccaactaaatcgaaacaggaagtacaaaagtccctgacctgcctgatgcatgctgcaaattaacatgatcggcgtaacatgactaaagtacgtaattgcgttcttgatgcactttccatcaacgtcaacaacatcattagcttggtcgtgggtactttccctcaggacccgacagtgtcaaaaacggctgtcatcctaaccattttaacagcaatataacaggctaagaggggcaggacacccaataaaactacgcttcgttgacatatatcaagttcaattgtagcacgttaacagtttgatgaaatgatcgtatctaaatgctagctttcgtcacattattttaataatccaactagttgcatcatacaactaataaacctggtgaatccaattatcgagatttattttttataaaattatcctaagtaaacagaaggatatgtagcattttttaacaattcaatcgttagtacagtcaggaaatagtttagccttttttaagctaagcaaagggcttttcctgcgacttacgttaagaatttgtaaattcgcaacgcgtaataagttgacaatgatcaccctgttcgcggttatttggtcaagaagagtggcaatatgcgtataacgattattctggttgcacccgccagagcagaaaatattggggcagcggcgcgggcaatgaaaacgatgggttttagcgaactgcggattgttgatagtcaggcacacctggagccagccgcccgttgggtcgcacatggatctggtgatattattgataatattaaagttttcaagacactagctgaatcgttacacgatgtcgatttcactgttgccaccactgcgcgcagtcgggcgaaatatcattactacgctacgccagtagaactggtgccgctgttagaggaaaaatcttcatggatgagccatgccgctctggtgtttggtcgcgaagattccgggctgactaacgaagagttagcgttggctgacgttcttactggtgtgccgatggtggcggattatccttcgctcaatctggggcaggcagtgatggtctattgctatcaattagcaacattaatacaacaaccggcgaaaagtgacacaacggcagaccaacatcaactgcaagctttacgcgaacgagccatgacattgctgacgactctggcagtggcagatgacataaaactggtcgactggttacaacaacgcctggggcttttagagcaacgagacacggcaatgttgcaccgtttgctgcatgatattgaaaaaaatatcaccaaataaaaaacgccttagtaagtgattttcagcttttcattctgactgcaacgggcaatatgtctctgtgtggattaaaaaaagagtgtctgatagcagcttctgaactggttacctgccgtgagtaaattaaaattttattgacttaggtcactaaatactttaaccaatataggcatagcgcacagacagataaaaattacagagtacacaacatccatgaaacgcattagcaccaccattaccaccaccatcaccattaccacaggtaacggtgcgggctgacgcgtacaggaaacacagaaaaaagcccgcacctgacagtgcgggc

SEQ ID NO: 8 - DNA, 20 bp, artificial
  fragment
gcgcaaagaaggcgcattca

SEQ ID NO: 9 - DNA, 19 bp, artificial
  fragment
gcaacgcggcctggcggaa

SEQ ID NO: 10 - DNA, 21 bp, artificial
  fragment
gagcagtatatattactggtg

SEQ ID NO: 11 - DNA, 20 bp, artificial
  fragment
ataccgacgacgccgatctg

SEQ ID NO: 12 - DNA, 20 bp, artificial
  fragment
cggcgataaagacatcttca
